United States Patent 10,160,976 (CHROMOBACTERIUM SUBTSUGAE GENOME) - sequence listing, part 2

SEQ ID NO: 1 - DNA, 4705025 bp, Chromobacterium substugae (residues 1,568,343-3,136,684 of 4,705,025)
  modified_base (5)..(5): a, c, t, g, unknown or other
  modified_base (7)..(7): a, c, t, g, unknown or other
  modified_base (20)..(20): a, c, t, g, unknown or other
  modified_base (380784)..(380784): a, c, t, g, unknown or other
  modified_base (398396)..(398396): a, c, t, g, unknown or other
  modified_base (453151)..(453151): a, c, t, g, unknown or other
  modified_base (500151)..(500151): a, c, t, g, unknown or other
  modified_base (808684)..(808684): a, c, t, g, unknown or other
  modified_base (916888)..(916888): a, c, t, g, unknown or other
  modified_base (1139584)..(1139584): a, c, t, g, unknown or other
  modified_base (1271431)..(1271431): a, c, t, g, unknown or other
  modified_base (1293924)..(1293924): a, c, t, g, unknown or other
  modified_base (1514851)..(1514851): a, c, t, g, unknown or other
  modified_base (1516434)..(1516434): a, c, t, g, unknown or other
  modified_base (1528711)..(1528711): a, c, t, g, unknown or other
  modified_base (1672252)..(1672252): a, c, t, g, unknown or other
  modified_base (1824790)..(1824790): a, c, t, g, unknown or other
  modified_base (2147963)..(2147963): a, c, t, g, unknown or other
  modified_base (2153200)..(2153304): a, c, t, g, unknown or other
  modified_base (2158890)..(2158890): a, c, t, g, unknown or other
  modified_base (2292853)..(2292853): a, c, t, g, unknown or other
  modified_base (2361816)..(2361816): a, c, t, g, unknown or other
  modified_base (2370011)..(2370011): a, c, t, g, unknown or other
  modified_base (2474461)..(2474507): a, c, t, g, unknown or other
  modified_base (2989447)..(2989447): a, c, t, g, unknown or other
  modified_base (3032640)..(3032640): a, c, t, g, unknown or other
  modified_base (3106965)..(3106965): a, c, t, g, unknown or other
  modified_base (3170939)..(3170939): a, c, t, g, unknown or other
  modified_base (3246515)..(3246515): a, c, t, g, unknown or other
  modified_base (3352429)..(3352429): a, c, t, g, unknown or other
  modified_base (3816903)..(3816903): a, c, t, g, unknown or other
  modified_base (4217325)..(4217325): a, c, t, g, unknown or other
  modified_base (4230954)..(4230954): a, c, t, g, unknown or other
  modified_base (4357679)..(4357679): a, c, t, g, unknown or other
  modified_base (4403286)..(4403286): a, c, t, g, unknown or other
  modified_base (4450659)..(4450659): a, c, t, g, unknown or other
  modified_base (4468392)..(4468392): a, c, t, g, unknown or other
tggtgacgatgttgacgagcgccttccacaccacttgtccgtagctgaactgcgggtcgtccaggctgccggccaccggcagatcgaggtcgatgcggccgttgctgtcttccagcagcgccacggcgaggcgcagcggcaggtgcggcgacttgtcgccctgcagttcctcgcccagctggatggaatcgatcacgatgcggttctcgcccttcagctggcggtgctctagcagatagcgcagctccagcgacaggcggccgtccttcacctgccagccggcgaagttcatcgaatacggattcaggttgttcagcgccaggttgtggaagtcgagatggatgtcggtgctgtcggtcggcgacgtcggcgacagcgcgccgcgcaccttcacctcgccgtactggtccaccgcgccgtccagcgtgatgcggccgcggccgccggcgcgggtcgacaggttctggatgctgccgcgcagatggtgcatgcgggtggcgaagtctggagtcatgccgtggtcggcgaactccaccgcgccgttctgcacgtggatgctgtgcacgtccacctgcggcagcggcgcgctcttgccggcaggctgcgcgggtttggccgccggcgcgccggcgaagatcttctgccagttgagccggcgctgcggatccaggatcagccgcgcgcgcggctggtccagccgcacgtcgttgatgctggccttcagcggcatgccctgcacttgcagcctgctgaggctgaggctgttccagcccagcagcggcagcgcttcgcccggctcctgcagcgccattttcgccagtttcaactggccggccagcttccactggctggcggaggcggcgtccagctgcaggtcggcggacagtgcgccgccggagagcttgagcggggtgccggccagcgcgtacggcgccagcggggcgatgggcagcgcgtcaagcttgacgctgccgcgggcggccagcttgtccgggttcaggtccagcttggcggccagcttgccgccgcccatccggccggcgatgtccagcgccagctgctggccgtcgcgggtggcaagctggccggacagctggtccatgctcagcgccagcggcttggccagggtcaggtcgcgccagttcatccggctgtcttccagccggatggccggatagctgaatttccaggccggcgtcttggcgtcgccgtcggcctttgccttggccgcttttggcggccgctgcgccaacagctgctgcagttgcagctggccgttgcgctcgcgctgcagcgccacttgcaggccgcgcagggtcaggtcgccgggtttcagctgctgttgcttgaggtcgatctgcgacggcgcgagctcggcgccgtccagcgtcagccagtcaggcgcgccagccgagcccagcttgacgccggccaggctgaggcctagatcgcccaactgcaggccgtgttccgggctgagcgaaatcctggcttgcatgcgcggcatgtcggcttgcagcgccatcggcttgacgaagacgtcatcgcgccactgcgcatgccattggttcagacgcaggctatccaccttgaccagccagggcgacggtttggcggcttggaccggtttggcggcggcgggcgcggcggggagcgcgcgcagccagtccaccatgccgtcggcgccgcggccggcgctgacgcggccatggttcaactccaccttggcgatggtcagcagcgagcgcgacaggtccagcgcgccgccttccactgtcaattccggcagcgacagctcgctggcgccgcccggcgccgccagcttcaggtctttcaggctggcgcggatcggcgacacggtgaggtcgggccggctgccgttcatttcaaactggtagcgggcgttgaccgacagcgcgccctgcggcttggccgtcgcgaaatagggatggacgtagtcccagaccgtcgccagcggcaggtcctgcatgctggcctcgccgctggattgcagcggctgcagccgcatgctgcctttccagtcgaagcggccgccgccttgcagttcggcgtgcagcgcgtagcggccgttttcggccagcgtggacaggtcggccaggttgaggttgatcggcatcagccggaagcgctcgtgctggccgtcgttatggtcgctcaggcggatctggccgctgcgcagattcagcgcggcgatcttcagccgcggcaacttttccggcgcggtgccgtcttccagtttgggcgggccggataggtcggccgccagcttttcccagttccacatgccgtcggcgccgcgctccagccacagctgcgggctgtccagcgtgaattcgctggcttgccagcgccccagcagcagcgcgtagaggtcggcgttcaggtataggcggcgggcgaggaacagcgggcggccgtcgccttcgcgcagcgccacgccgtcgagcgccagctccatgctccagggcgtgatgcgcacctgctggatgctgagctggcggccatgcttgccggcccagtcggcggcggccttttgcagcaggcgcggcccggccaggccgagaaaggcccaaaacgccaatagcagcgcgagggcgacagccagccaacgcagccagcggcggggtttgcggggagagggggaaggggcggccgcgtcggcctgaacatgggtattcatatcgattaattctaatacactttggccctgccgtcctgttgcgttgtttgtcctattgttgaccaaagttgacggcggaatgggggcgaaccgttgccgacggcgccgactgctggctaggatgggcaggtgttcaagatattgaacgcaaaatttgccaaatttttatcaggaaaggttgattatcttgcaacaaagctaccggccacgccggtcattcatcttattttcaacagacgcggccacgccgctgctggcggaccgctgcctgttcctgctgcaggccgggcggcgccacaccctggccaatccggccaggctgctgggtagctccggtacccatacataagacagaggtttcaatggatagtgccaatgcaatcaatcaatggctggacgaacaccatatcaccgaggtggagtgtctgatcccggacatgaccggcctcgcccgcggcaagatcgtgccgcgccacaaatacaaccccgccgaggggttgcgtctgccggaggctgtgttgtcgatgacggtgaccggcgattaccccgaccgcgacttcacctcggtggccgaccccgacatgaagctgatccccgacgccagcacgctgcgcccggtgccgtggaacaaggaacccaccgcgcagatcatccacgactgttactccttcgccggcgacgcggtggacctggcgccgcgcaatgtgctcaagcgcatcctcaaactatacgaagacaagggctggaaggcggtgatcgcgccggagatggagttctacctggtggaaatccagccggacgaggacctgccgctcaggccgccggtgggccgcacccgccgcaccgaagcgggcatgcaaagcttcagcatcgatgcggtcaatgaatacgacgacatcttcgacgtgatgtatgactggtgcgaggcgcaaggcctggcgctggacacgctgatccacgagatgggcaccgcgcagatggagatcaacctggatcacggcgaccccttgcagctggccgaccaggtgttcctgttcaagcgcaccgtgcgcgaagtggccatccgcaacaatatgtacgccaccttcatggccaagccgatgcagggccagcccggcagcgccatgcacatgcaccagagcgtggtggacatcgccagcggccgcaacatcttcagcctgcaggacggcggcccgtcgccggatttcctgcatttcatcggcggcctgcagcgctacctgccggcggcgatgccgtttttcgccccctatgtgaactcctaccgccgtctcagccgctacacctcggcgccgatcaacctgtcctggggctacgacaaccgcacctgcggcctgcgggtgccgcattccgggccggaggcgcggcgggtggaaaaccggctggccggggtggacgtcaatccttacctggcgatggcggccagcctggcctgcggctacctgggcatgcgggaaggcatccagccgtccgagccattgaccggcagcgcctacgagcagccgcaccagctgccgcgccatctggatgacgccatcgacatgctgttgcgctgcaagccgctggccgagttgttcggcgagcatttcgtcgaaacctacgccgcgatcaaggaggtggagtaccgcgagtatttcgacgtgatcagcccctgggagcggcggtttctgctgttgcacgtctaatcgtacctgctgtgtgtccacgccttcccgccttaatcggctggaaggcatttttgtgtcaggcggcggaagggggagggcggcaggagcaagtgcgcgtcgcgcctccgccctgggcagtgcgatttggcaggcgacatcatggaacggattgggaaacgctataaaaataaggctcaaatatgagcctaatgtgcaaaagaaatagatcagttggtttcaatggattttaaaattatttatgcattttgctgtggatgtggggagtctaaattttcaactgcaaaattatgttgacaattgaaaagtaacctgtgcacaatcaaaaaggcaggatcttcaagcgtcatatctatcgacacctcgttgcccacccagttggtctacatagtttccttatctattccttgattatcatgcttttggcgattttattgccctttacaaacacaaggagtgcattatggaaacgggtaccgttaagtttttcaacgacgcaaaaggttttggttttatcacgccggacaatggtggtgatgatctgttcgctcatttttctgaaattcgtgctgatggtttcaaatccctgcatgaaggccaaaaggtgagctacacccgaggtatgggccaaaagggtccggcagcaactggcattcagcctctttaatttatcgctgctatcaaaaaagccctgtaggggctttttttttgtctaggccttccgtttcggcattgctggatgtctaccgagatagcgattaaatagccagctcttcctgcgtcttgccttgatccagcagtgcttgcccccacagcggcttacgaccgcgtccacaccaagttagggaagcatcagcaggatggcggtacttttcctctaccggcttcttaggcctgctagcaaaacctatcgataaatcgcatgcagatcaatgagaaagccagcttgagcaaaggaccgttgggctaagcttgcgaagcccaaccttcttggtccggagttctacggccgtacggtgcaatcgtagggtgcgatacccggcctcgacctttccgccacgctgcgtcattcgccgggcgtcgcgccgcttctgcccaacacgccaatcggtgcgatgcctggcggttgggttggcctcatgcatccggtgaaggccgggttcgcattctacgatgcttggcatgcgtttgacatgtcggtcaaggttgctatggccttcggctaccgctggggggcccgcaatcgggcggcccttcgcatccggcaaggacagtttgcctcatcacttaagtggccatccagcgcagacctacgccggctgctgctgcgtcgtgcagtggatgccgccgccgcctgccgctaccgcgtcgatgtccagctgcaccacttcgcggccggggaatagttcgcgcaggatggcgcggcagttggcgtcggcgcgggagtcgccgaattgcggggcgatcaccgcgccgttgcagatatagaagttgacgtagccggctgcgaattcgcggttttcgaagcgcggacgcacgctggacgggccttccagctccaccacttccagcgggcggccccgggcgtcgcgggcggtgcgcaggatggccagatggcgccgcgtcaccgcgtagtcgtaggacgacgggtcgctgtccaggccggccaccaccacgccgggcgccgcgaagcgggcgtagaagtcggtgtggccgtcggtgatgtcgcggccggcgacgccgggcagccagatcaccttgtccacgcccagcagccgcttcagttcggcctcgcaggcggccttgcccaggccagggttgcggttggggttgagcacgcagctttcggtgatgatggcggtgccctggccgtccacttcgatgccgccgccttccagcaccaggcggctggagagcagcggccggcccgattgcgcgcagaccgcggctgccaccctggcgtcgcgcccatgcgcctgcttgccgccccagccgttgaaatggaagccgacgccggcggcgcggccctgggcgtccttgacgaaaacgggtccggtgtcgcgcatccacaggtcgtccagcggctgctcgatcaggcgcacgccgtcgccgcacaattgacgcgccaattccaggctgtctttcggcgccagcatcgccaccggttcgaacgccgagatggcgcgggcgatgccggccaggttttgccggaccgggcccagcaggcgctcgccccagatgtccgcgcgcgcgccgaaggccatccaggtggctgcgtgcggttcgccctcatccggtatgcgccagccggactgtgcggggcgcggcggggcggcgagggcgccgcccagcagcagggcgctgccggacagcagggaggcgtgtcgcaaaaaacggcgtcgattcatggcgtactccggaaggcggcgggcgccgctggtttatcaaatagtcgtcgccattgtccgtgttggccgctattttgaaaattgatgataattgcggctattaatcaacttttttcatgattcggcgatgcgcactccttccctgaaactgctgctgggcttcgaggccgccgcccggcacggcaatttttcccgcgcggcggacgagctgtgcctgtcgcaatcggcgatcagccaccaggtgcagcaactggaggcgcaattgggccagcccttgttccgccgggtggggcgcggcgtggagctgacggtggccggggaagtgctgcagcaaagcgtgcggcgggcgctggacaatctgcagggcggcctggggcggatcgccggctatatggatccgggtctggtggtgctggtgtgtccggcggggctggcgcatggttggctgcagccccggctggcggatttgcagcggcggctgccgcaattgagcctgttgctgtccaccgacgagagcgcgcgcttcatcgatgaaatcgacgtcgacatcgtgatcgccgaccggcccttgcagcaggccggcgtcgcggagcggccctggctgcgcgacgagtgggtggtggcggccgcgccggagctggcgcggcggctggaggcggcgcccatcgagcggcatcccgagctggccggcttgctctgcctggaggacggcttcaccgacgcgcgcgccggcggcttgtttcgcggccacctggccggctttcgccgcgccggcgtttacgacgatgcccggctgctgctggacgcggcgctgcgcggacagggggcggcctgtctgccggcgctgctggcggatgaagcgctggcggatgggcggttgcgccgcctggcgggctatcctgccgccgccggcgcgcagtactggctggcacgcgccgacggcgagccgcgcgccgccatcgtggcggcggtggcggattggctgctggccaaggcagggctggcggcttcagtctagcgcggccagcgcttcggccagcatcgccacgccgttgtgctgctgcagcgggtcgtagaagctgaagttgagccgcatcgcgttcaagcgcggctgattgtcctggaagaacagcggcgccggcgcgaaatggatgccttgctgcatcgcctgggccagccggcggcggcagtccgtgccttccggcagctccagccacaggaaatagccgccttgcggcgcgatctggcggctgccggccggcatgtggctgtccagctgctggcgcatcgccagccagttggcctgcagccggctgcgcagcaggctgagcatgtcctcgtggtggccgccggccagcagccgcgacagcgccatctggctgggcagcggcgtggacagcgagctgcacagcttgaggcccaggatgctgtcgcggtagcgcccggcggcgatccagccgacgcggtagcccggcgccagcgatttgctgaatgacgagcagtacagcacgctgcctttctggtcgtaggccttcaaaggcagcggcgcgctttcgccgaagtacagctcgcggtaggtgtcgtcttcgatgatgggcaggcggtgccggtccgccagcgccagcagcgccgccttgtcatggtcgctcatcgtcaggccggtggggtgctggaagttggccatcgccaggatgccggccggctggtgctggacgatcagttgctccagccgttccaggtccagcgcctggccgggcggcgtggccagcgtgtgcgccgcgatgcccagttgctccagttggtcgaacagcgccgggaaggccggggtcagcaccagcatcgccgcgctgccggacaatttggtcaccgcccgtatcgccaggttcagcgcttccatgccgccgcaggtcaccaagagctcgtcgccgtccagctccacgccctgcgccagataacgcagggtcagctcgcgccgcaggccttcgtagccggtgctgccgttgccggacagcgcgtagcggtagtcgcgcagcgcgcgggtgagggcgcggttgagcggggtggtgttgatcagcgccgggttcatgtacggacagccccagggcatgggcagcgcgctggtcaggtgttcgatgcggatgccgctgccgtcgctttgcagcggcaggttgctgggcaggacggcgctgcgcgccagcacccggaagccggagcgcggcagcgattcgatcagccccagtttctccagttcggcgtaggcgcgctgcgcggtggtgatgctgatcttgtggtcctggcataccttgcgcagcgagggcatgcggtcgccggcgcgcaggtggccctgttctatcgcgtggcggaaacgttggctcaattgcccggtcttgttcatgtgctgattccgatccgcctcattctccgatgaagctggacttttccttgatggtgacgtcatcgcccaacgagcgtatcacgaagtggatggggtgggcgccgcggccggcgtgctccggatcggcctgcacccgcactgccacggtttcggtttgcgccggcttcaccgcgatgatctggtccggctggtccagccggatgccgggcaggccttccaccgccaggctgtagcgctgggtttgttccgtggtgttgatcaggcgcaggttgtagcggttctgcagcaggccgtcgtcggtttgttccaccaggctggcgcggtcgcgcagcacgtccaccttgaacggcttcttcagcgccagcgcggtggtggacaaggtgatgatgccggccagcaggcaggagtagacgacgatgcgcggccggtgcagcgacttggccggcgcgggctggccctgctgcgcctgggcgctggtgtagctgatcagcccgcgcggcgcctggatcttgtccatcacctggtcgcaggcgtcgatacaggcggcgcagcctatgcattcgtattgcaggccgttgcggatgtcgatgccggtggggcagacctgcacgcagatgccgcagtctatgcagcccttggtcttggcctcgctgcgcgcctgctgcttgccgcgcggctcgccgcggcgggcgtcgtaggaaatgaccagcgtgtggtcgtcgaacatcgcgccctggaagcgggcgtacgggcacatgtgcaggcagaccttttcgcgcagcaccccggccagcagccaggtgaagccggcgtagaacaaggtccagaacaggtcccacggccccatgttcagcgtcgccagctcgcgcatcggggtgaagtagccgacgaaggtcaggccggtccacagcgaaaacgcgcccatcagcagctgggtcagccccttcttggcgaacttgccggcgctcatcggcgccgcgtccagcttgcggcgggcgttgtggtcgccctgcaccagtctttctatccagatcatgatctgcgtgtacacggtttgcgggcagctgtagccgcaccacagccggccggccagcgtggtccacaggaacaggcccagcgcgcacaccaccagcagcgcggccaggtagatgaagtcttgcggccacaggctgatgccgaagatcaggaagtggtgctcggccaggttgaaatgcaccgcctggcggccgttccattgcagccagggcaggccgaagaataccagctgggtcaacgccaccatcgagacgcgcagcgtgttgaagcgcccgctggtcaggcggggatagatcttgatcggtttggtttcgagcttggacatggctgccatcgcatgatgaaggatgggtcatttgtactgccgggcatcggtacaaacaatgcacagaactgcgccggattatgtgcacagatgcggctgtatacctacagcggcaggctaggcttggcgcggaaccgcttcctgcaagggtttggccggctgcggccgcttgccggcgcggcggccgggatggcgggcatggtatatttgcgccgcatagggttttgaacgaagtggaaatttcatgatttatatcaatgatcagcccgcgcccgggcaagacggcgtggaagacgcggatcagcagccggcgtttttcgccgtttcgccgcagaagcttttcgtcatgtcgctgagcacgctggggatgtaccaggtctactggatgtatcgccactggcagcgggtgaagcagcgggaaggcagcgatatctggcctttctggcgcgcgctgttcggctatttcttttgctacgcgctgttccgccgcattcacgacgactgcgagcgcgctagcgtggaagggctggcggccgggccgctggcggcgggttgggttgtcatctgcctgctgtggaagctgcccgagccttactggctggtcagccacgccgcgatcctgctgctgttgccggtgcaggcggcggcgtgccgggccaacgaggcgctggctcccggccatgcgcgcaacgacggctacagcggctggaacatcgccgcgattgtgttgggcggcatactctggctgctggccatctacggcatgtttttcatcaagaactgaggcgcctgccgcgcccatcactctcccggatcctgccagtcctgcgccttcccatgttcccatcctgtcggcggcgggtcgcttcggcgcgcccgccgccggtgctatgttggcaagcaattgagcagcttgtggcgcgatgcgcggatgaattccgcacccgcatcgcgactccgggaggggtggaatatgtggtggccgtttttattgctgggcttggcctattgcgcgttgggcttgctgccgcgcgaggcgctggcggggccgaataggttttcttccggcgccggtgcgccggaaaccgggcttagccggatggagctccgcagccgcggcgtctgcgcccgctttgcgatagtgggtgttttgacgcctgcggcggtactgctgctggcgccgtctccctctgaggagagcaggccctttgtgctgtacttcatgctgccgacagccatgtttttggcattgtttccctcttgtctggccgggtggctttttacccgcgtgatccgcaaagtgatcgcgggcagcggctacgagcgggcgcgagctgtggcgcccagaaccggcggtttgtgcagcttgctggcggtatggggggcggcggatttttgctctgcatcggtggaggccgcagtgacatgatagtcatcatgttgatcttgttttccgtcgccggcttgcccggcggggcgctgtccggcttgctatgtcggagactgttgacgctttaacccggccacgagcctgcgcgtcgtgcgggggcattgccggcttccgtgatgaattgggagaatgcgatatgaaaaagatgattctcgcctgtagtctgctgttggccttcggcgtggcccaggcccagccttacggccatttcgacatgcgccagatgctgatgccgcatgccgagggcgatgcgtcgtaccggctgaacctggagtatctggaccgcgtgctggacgatctggccggacacgcgcgcaactatccgcccgcgttcgacagccaaggcgacaagcgccaggccctcaatgacgccaagaaactgtccgacatgctggaaatcgtcgccggcggcggccaggccgacaccgaactgctgatgcgggccggtttcctgaacagcatggcttacaacctggacgtgccgaagtccggcgggcgagcccaggccgccttcgccgccgtactgcaaagagagccggacaacgccaacgcccactatctgtacggcagcttcctggccggcatgggacatgccaaagaagcgctgccgcatctggaccgggcagtggagctgggccagcaggaggcgctctactcgctgggcatggcctatctggcgctgggcgacaaggccgccgcgttgcgcgagctggaagcctatcaagccggccatccgaacgaccgcagcgtaggcggcctcatcgaagccgtgcgcagcggcgccggttcggtgcagcgctagcgcgggctagctgccccgcggcgggtgggtcgagttggcctgcaccgcggagaaatggttgaccacgtcggccagctgcgaagtgctggcgcggatctcgtctatcgaggtgctggccacgctggcgtgttcctcgcccagctgggccttgaccagcatttcgtggatgctgtcggtggcgctgccggtgccggtcttgatgtcgtctatcatctcggtcacctccttggtggaggcgctggtgcgttcggccagcttgcgcacctcgtcggccaccaccgcgaagccgcggccttgctcgccggcgcgcgccgcttcgatcgccgcgttcagcgccagcagattggtctggtcggcgatctcatggatggtgttgacgatggtggtgatgcggccggttttctgttccaggtcttcgatcagccgggccgacttgccggcgctgtcggcgatcacgttcattgcccggatggtgtcgcggatcacctgctggccgtcgttggaggcgctgtccgacgccgccgacagccggtgagcctcctgcaccaggcgcaggtcttcctggcgggcggtttcctggtcggaaatgtcggtggcgaatttgatcaccttgcataccgcgccatcgtcgtcgaagatcgggttgtagctggcttccagccagaccggccggcccgatttgtggcggcgctcgaagcgcccggtgacgaacacaccctgtttcagcgtgcgccacagttcctcgtaggccgggctgttgacgaagtcggcggggcagaggatgcggtggtgcttgtcgacgatctcatcggcgctgtagccagtggcggccaggaaattggcgttggcggcgagaatcacgccgtccggcgtgaactcgatcaccgccatcgagcgccccaccgctttcatggtgttgctcgcctcgtgggcgatcttgacttcatgcgtgatgtccagcgcgaacttgaccaccttgaccacctggttgttgtggtcgcggatggggttgtagctggcctccagccagacggtgcggccatccttggcgatgcgcctgaactgatccttgacgaagcgcccctcgcgcagcatttgccagaaagccaggtattcctggctggcggcgagctgcggcgggcagaacatgcggtgatgcttgccgatgatctcggcggcggcatagcccatggtctgttcgaaattggcgttggcggccaggatgatgccgtcggggctgaattcgatgatggcagtcgaccggtccagcgcatccagcacgcttttctgcccttccagttgcgacagagcgtgactcaggtcggacttcagcttttgattgaacatgctcagatatcctcaacggatagatggtgtgcgcgcttgtgtttattcggtgtatgaaagccgcaactgcttagtcaagtggcaaatgcgagaggctggcttgtagacaggagcgtgcattcggcgccgcggcggattttgaaatcaggcggcgccggctggcggcgagcgcagagggctatggattttctggttcatcagcggaacgggggctgcgtggtgcggcgcgggaccccgctggatggcgtcaatcaggcggtcgatccggcgacggcatgcgttgaacgcggcggccgccggccctatgcgccggcggcggcgccggtgttcagcgcgtcagctgcggaaacagccggtagacgccgtcgacgatgatttccaccgataccgccgccagcagcatgcccatcacccggttgacgatgttgatgccggtctggcccagcaggcgggtgagcggcgaagccagcaccagcgcgccgtagcaggtgatggcgaccagcaggccgctgatgagcagatagaccacctgcacccaggaatgggcggtggtggcgtagatgatcacggtggagatggtgccggggccggtcatcagcgggatggccatcggcaccaccgcgatattggtcttgtggccggcttcttctctttcttgcttggtggttttggtggggccaggcttggcgttcatcagcgcgatggcgatcagcatcagcaggatgccgccgcccacctgaaacgagcctatgctgatgccgagaaagcgcagcagggtctggccgaccagcgcgaacaggcacagcaccacggccacggcgatggcggtggtcttggctatcttctggcgttcttcctggctggcattgggcgtcaggctgatgaaaatggggatggcgccgagcggattgaccagcaccagcagggcgatgaagattttggcgatttcgatttccatgtcgcggagcttacctgttagcgttgtcgggcacattcaaaggggggacgcaaaccaccacggctgcgccagcggcgcggcgaaaagaaaaaaaccggcatccctgccggtttcagcatagcgaagcggcggcgctcacgccttggccagcagcaactccagcgtgcgccggtagatatcggacagcggctccacgtctgccacttccacgcactcgttcagcttgtggatggtggcgttgatcgggccgaactccaccagctcgcgggcgatgcgcttgatgaagcggccgtccgaggtgccgccggtggtggacagctcggccttggagccggccacttcggcaatggcggcgctcaaggcttccgtcagcgcgcccggcggcgtgatgaagggctggccggacagctgccagtgcagctcgtagcctaggccgtgcttgtccaggatctggcacacccgttccttcaggctgtctgccgggctttccggcgagaagcggaagttgaacagcagctcgcagtggccggggatgacattggtggcgccggtgccagcctgaatgttggacacctgccagctggtgggcgggaagaagtcgttgccttcgtcccagcgggtggcggccaattcggccagcgccggcgccatcaggtggatggggttcttcgccagctgcgggtaggcgatgtggccctggatgccgtgcactaccaggcggccggacagcgagccgcggcggccgttcttgatggtgtcgcccagccgctgctcggaggtcggctcgccgacgatgcagtagtctatcgtctcgccgcgcgcctccagcgcgtccaccaccttcaccgtgccgtccaccgccacgccttcctcgtcggaggtgatcagcagcgccagcgagccctcgtggtccggatgggcggcgacgaaacgctcgcaggcggtgacgaaggcggccagcgacgccttcatgtccgccgcgccgcggccgtacagcaggccgttgcgcacggtgggctcgaacggcgggctgtcccatttttccagcgggccggtgggcaccacgtcggtatggccggcgaagcagaacagcgggccggcgccgcccctgcgcgcccagaagttgtcgacgtcgccgtggcgcatcttctccaccttgaagccgatggcctccaggcggtctatcatcagcgcctggcagccttcgtcgcgcggggtgacggaatcgcggcggatcaattcgcgggccagatccagcgtcgcgctcatttgccgaagcgctccgcccagtcggcctcggagaagccgacgccgaccttgccgtcccactccagcaccgggcgcttgatcaccgaggtttgctcccgcatcagcgcgatggcgccgtcgcgggtgtcggcggcggttttggccgcgtccggcagcgcgcgccaggtggtgccctggcggttcaccagcttggccagcgggacttgctcggcccaggccgacaggcgctcggcgtctatgccctgtttcttgaagtcgtggaaggtgtagtcgatgccgttgtcggccagccattggcgggccttcttcacggtgctgcagttgggaatgccgtacagggtaatcatggggtgggtttacaggtccagtttgatgctgtcgaagctggccgcgctgtcggggccagatttgttcttgtccgcggcgccttccttggactgattgaccagccagtacagattggtcggcgaatcggcgtttttcaacgcctcgtccaggctgacgcgtccggccttgtacagctggaacagcgcctgctcgaaggtttgcgagccatcgctcatgctgctctcgatggcctccttgattttgtctatctctccggttcgaatcaactccgaaatgtgcggcgtgttgatcatcagctcgatcgccggcacccggccgccgtccagcgtggcgatcagccgttgcgacaccaccgcccgcagcgaggccgacaggtccatcagcaaggtattgcggctttccggcgggaagaaattgatgacgcggttcagcatgtgatagctgttgttgccgtgcagcgtggagatgcacaggtggcctgactgggcgtaggtgatggcgtggcccagggtttccgcgtcgcggatctcgcctatcatcagcacgtccggcgcctcgcgcatcgcgtttttcagcgcgcgggcgtaggacagcgtgtcgaagccgacttcgcgctggttgacgatggatttgtcgtgccggtacaggaattcgatgggatcctcgacggtgaggatgtggcccttcatggtctggttgcgcgtttgcagcatcgccgccacggtggagctcttgccggagccggtggagccgaccaccaggatcagtccgcgcttttgctggatcaggctcgccagcatgggcggcagctgcagctgctccagcgagggaatgctgggcaggatgtagcgcaccaccatgccgaccgagccgcgctgccagaagatgttgacgcggaagctgccgaggcctggcactgggtggcccaggttcatctcgcgctcgcgttcgaaaaccgcgatttcttcttcgctcatcaggctgtaggccagctgtttgaccatgtcggcggtcagcggcttgtcgttgaccggttgcaggtcgccgtccagcttcagcatcggcggcgagaagctggtcatgaacaggtcgctggccttgcgctcggccatcagcttgaagaagggcagcatcagcatcggtggctctcccgcgccggtcggcggcgcctgtgcttcagtgtagccgcgccggcggcgggcaacaaaaaaccgccgggcggggcgcggcggttgctgggacggcggatgcgtccgtcaggccggtttggcggtttcctggtcgcgcagcgcgcggcgcaggatcttgccgacgttggtcttgggcagctcgctgcggaactccaccagcttgggcactttgtagccggtgaggttttcgcggcagtgacggatgatgtccttgtcggtgagggcggggttcttcttcaccacgaacaccttgaccacctcgcccgatttgtcgtcgggcacgccgatgcaggccacttccagcacgtccgggtggctggccaccacgtcttcgatctcgttcggatagacgttgaagccggataccagaatcatgtccttcttgcggtccaccagcttgacgaagccttccggcgtgaccatggccatgtcgccggtggcgaggaagccgtcggcccccagcaccttggcggtttcatccgggcgctgccagtagccgcgcatcacctgcgggccgcggatgcacaattcgccttgctcgccctgggccaccggcttgccttcggcgtcgcggatctcgatgtcggtggacgaaatcggcaggccgatggtgccgttgtattccttcaggtccatcggattgatgcaggcggccgggctggtttcggtcaggccgtaggcttcggccagggtcacgccggtcacggccttccacttgtccgccaccgctttttgcaccgccatgccgccgcccagcgtcaggcgccaggtggagaagtccagcttggagaattccgggtggttcagcagcgcgttgaacagggtgttgacgccggtgatgcaggtcaccgggtatttcttcatctccttgatgaagcccgggatatcgcgcggattggtgatcagcaggttgagcgcgcccatattggtgaacaccatcagattggcggtcagcgagaatatatggtacagaggcagcgcggtgacgatcacttcctggccttcgcggatcagcggtttgacccaggcgttggcctgcagcatgttggcgacgatgttcttgtgcagcagctccgcgcccttggccacgccggtggtgccgccggtgtattgcaggaaggcgatgtcgtcgtgggtcagcgccggcttgacgtaaggcttggccgcgccggcggagagggcgtcgttgaagcggatgtggccgggaatgtgccacggcggcaccatcttcttcaccttgcgcaccacgaagttgaccagcgcgcccttggcgaagcccagcatgtcgccgatggaggcgatcaccacgttcttcacccgggtgcgcggcagcacctgctccagcacgccggcgaagttctccagaatgacgatggtttccgcgccggagtccttcagctggtgctccagttcgcgcggggtgtacagcgggttgacgttgaccacgatgccgccggcgcgcagcgtgccgaacaccgccagcgggtattgcagcagattgggcatcatcaccgccacgcggtcgcccttcgccaggcccagcttgtgctgcaagaaggacgcgaactggccgctgagcgcgtccagctccgcgtagctgagcaccttgcccatgcaggcgagggcgggccgatcgctgaatttcttgacgctgcggtcgaacacctcggtcaccgactggaactgattgatgtcgatttcgtgggcaaccccagcctggtagtttttaagccacaccttgtccataaatccgggtttctccgtcgtgcaggttgttttagcgagcatcgcccccggcgggccggaggcgaatcggtttagcgtgtcgctatttttttagtcgttgtcttggcggcttcgggccgctgcgctcaaacttgggtttgatccgcggtaatgtaccgtaactgaaatcgtctcgcaaaaattgtctggcatagcccggcctccggctggaggcgggaggggctacaaggttttcttttctttggaaataggttacaatcgcagcggttagggatgggcgtttcgcccattttttatttgtggaaaaagcaatggatgttcgtttgctgctggaaagcacactgcaggggttcggctacgagttggtcgattttgaaatcaccccgggtggcggttttcgcgtatttatcgacaagcccggtggcatcaccgtggaagactgcgtgctggtgagcaatcacctcactcgactcttcatggtcgagaacgtggactacgagcggctggaagtgtcttcgccgggcctggatcgtcctctgaagaaggaagccgattttgtccgtttcgcaggtcagctcgccaagatcaagacgcgcatgccgatcgagcagcagaagaaatttaccggtcgtcttgccggggtcgaagacggctccgtgaagcttgaggtggatggccgcatcgtggcgataccgtttgccaatatcgacaaggccaggattgagcctgagttttgaggtcggcgcggcactgggccacgtaaaaggacaaaattcggagaggaatgcatgagtcgcgagattttgttgctggtggatgccctggcgagcgaaaagaatgtcagcaaggatgtggtgttttccgcccttgagatggcgcttgcttcggcaaccaaaaagaagtttaccgatgacgagatggatgtgcgcgtcgagatcgaccgccacaccggtcagcatcagaccttccgccgctggacggtggtggaggacgacctgcttgagtccgagagcaaggaaatcggtctgaccgacgcccgcgagcgcgatccgcgggtggaggtcggtgccgtcatcgaagacgcgatggaagcggtcgagttcggccgcatcggcgcgcagaccgccaagcaggtgatcctgcagcgcatccgcgacgccgagcgcgagcagctcctgaacgagttcctgcagcgccgcgagcacctggtgatcggcaccatcaagcgcatcgagcgcggcaacgccatcgtcgagtgcggcaagctggaagccgttctgccgcgcgaccagatgattccgaaggaaaacctgcgcgtgggcgaccgcgtgaagtcctacctgctgcgcatcgatcgccagggccgcggcccgcagctgatcctgtcgcgcaccgcgccggaattcctgaccaagctgttcgagctggaagtgccggagatcgacgaaggcatgctggaaatccgcgctgccgtgcgcgacccgggcatgcgcgccaagatcgccgtcaaggccaacgacgcgcgcatcgatccgcaaggcacctgcatcggcatgcgcggctcccgcgtacaggccgtcacgcaggaactggcgggcgagcgggtcgacatcgtgctgtgggcgccggaaccggcccagttcgtgatcaacgcgctgtcgccggctgaggtgagccgcatcatggtggacgaagacaatcacagcatggacgtgatcgtcgaggaagagcagctggcgctggccatcggccgcagcggccagaacgtcaagctggctgcagagctgaccggctggtacctgaacatcatgaccgtcgccgaggcggaagagaagaaccaggcggaagacgctgcgttgcgtcagctgttcgtcaccgcgttgagcgtggacgaagagaccgccgcgaagctggtcggcgaaggtttcgccgcgttggaagaagtggcctatgtgccgctggaagaaatgctggaaatcgaaggcttcaacgaggagctggtgggcgagctgcgtagccgcgcccgtgatgcgctcctgacgcaggccatcgcgtccgaagagcaggttgaaaatgtatccgacgacctgaaggacgttgaaggcctggatgccgagctggttcgcaagctggccgcaggcggcgtgtccacccgcgacgatctggccgacctggccgttgacgatctggtggacatgaccggcatggaagcggaagctgcacgcgccatcatcatgaaggcgcgcgaacactggttcaaccagtaaggctttctcgggaagtatttacggaatttgggaagacgcatggttttgacgaatgtaaaacaatttgccggtgagatgaatctcacgccggaacgcctgctggaacagctgaaggctgccggtgtgagcaagcgctcgccggaagacacactgtcggcgcaagacaagtcccagctcctggactacctgaagcgctctcatggcgcccgcgaggattccaacatcacgctgacccgcaagtccacttccgaagtgaagaaggcggacggcggcaccgtgaccgtggaaacccgcaagaagcgcgtggtcgttcgcccggaagaggcgccgaaggcggctgctccggtggaggcgaagatcgagcagcccaaggttgagcccaaggtggaagccaaaccggaaccgaaaccggagccgaaaccggagccgaaggtggaggccaagcctgagccgaagccggaacccaaggtcgagcccaagccggaaccgaagccggctccggcggcccgcaccgtggcctccatcctgtcgccggaagaaatcgccgcgcgtgaagccgaggaaaagcgccaggcggcattccgcgcccgtcagcaagagctgatgcgcgaaaagatcgaacgcgaagagcgccgtcaggcagccaagctggccgcatcgcagccggctccggtggtggaggccccgcgcgcgccggaaccgcaacgagagcagcgcgatgagcgcggcccgcgtccggcggctggagacaaccgcggcccgcgtccggctggcgacaaccgcggcccgcgcccggctggcgataaccgcggcccgcgtccggctacggctggcgcgcccggcgctccggcgattccggctaccgtcgccggccgtccggatgctaagaaaggcggcaacaagaagggcggcgaccgctgggatgacaacaagaagggcggccgcggcggtctgaagaccaagggcggcgacgccggcaacgattggaagtcgcgcggcggcaagggcaagcacaagcaaagcaacaatcagcacgctttccaggccccgaccgaaccgatcgtccatgaagtgctggtgccggaaaccatcacggtggccgaactggcccaccgcatggccgtcaaggccgtggaagtgatcaaggccctgatgaagatgggcatgatggtgaccatcaaccaggtgctggaccaggaaaccgcgatgatcgtcgtggaagaaatgggccacaagccgaaggccgcccaggcggacgatccggaagcctacctggaagtgaccgatggcgaagctgtcgaagtggtggaactgccacgttccccggtggtgaccgtaatgggccacgtcgaccacggcaagacctcgctgctggactacatccgccgcgccaaggtcgccgcgggcgaagccggcggcattacccagcacatcggcgcctaccacgtggaaaccccgcgcggcatgatcaccttcctggataccccgggccacgaagcgtttaccgcgatgcgtgcccgcggcgccaaggccaccgacatcgtcgtgctggtggtggctgccgacgacggcgtgatgccgcaaacgatcgaagcgatccaccacgccaaggccgccaaggtgccgatggtggtggcggtcaacaagatcgacaaggtgggcgccaacgtcgagcgcatccgccaggagctggtgtcgcacgaagtggtcccggaagattggggcggcgatacccagttcatcgaagtgtccgccaagatgggcaccaatatcgatgcgctgctggaagccatcctgctgcaagccgaagtgctggaattgaaggctccggtcgacgcgatggccaagggcatcatcgtcgaggcccgcctcgacaagggccgcggtccggtcgccacgctgctggttcagtccggcaccctgaagaagggcgacgtggtgctggctggcaccgccttcggccgcgtccgcgcgatgatggacgaaaacggcaagccgatcgaatcggccggcccggctatcccggtggaaatcctgggtctgtccgacgtgccgcaagcgggcgaggacaccatggtgctggccgacgagaagaaggcgcgtgaaatcgcgctgttccgcgccggcaagttccgcgacgtgcgtctggccaagcagcaggcttccaagctggagaacatgttcgcccagatgaccgaaggcgaagtgcagaccctgtcgttgatcatcaaggccgacgttcagggttcgtacgaagcgctggcgggcagcctgcaaaaactgtccaccgacgaagtgcgcgtctccatcctgcactccggcgtgggcggcatttcggaatcggacatcaacctggcgatcgcctccaaggccatcgtgatcggcttcaacacccgctccgacgccgccgcgcgcaagctggccgaaaacgaaggcgtggacatccgctactacagcatcatctacgatgccgtggacgaggtgaaggctgcgttgtccggcatgctggctccggagaagaaggagcagattctgggtaccgtcgagatccgtcaggtgatctcggtgtccaaggtcggcaacatcgctggttgcatggtcaccgacggcatgatcaagcgcaccgcttcggtccgcctgatccgcaaccacgtggtggtgcataccggcgaactggaatcgctgaagcgcttcaaggacgacgtgaaggaagtgcgtcaaggctacgaatgcggcctgatgctgaagaacttcaacgacatccaagaaggcgaccagttggaagcgttcgagatcgtggaagtggcgcgctccctgtaaggggaacgccaggggcgggtgccggttggccgaaaggccggcgggcgctcgccctttttcatatcgatgctgcaaaaacccgcaaagcgcatgccgacaggcgtgcgctttgccggggtttgcggccaggcggccgaaccggccgcgacagaacagaattggaagtgacatggcaaaagccaaaaaaggtttctcccgcgccgaccgcgtgtccgagcagatccagcgcgagctggcagaactgacccgcaccggcctgaaagacccgcgcgcgggctggatcaccatcacccaggtggaagtgacccgcgattactcgcacgccaaggtgtattacaccgtaatggtggaatccacccgcgcggccacccaggaggcgctggaaagctccgccggctacctgcgcaacgaactgggccgcagcatcaagatgttcagcatgccgcagctgcatttcgtctacgacgagtcggtggagcgcggcatgcacctgaccagcctgatcaatcaggtggcgcgcgaagacgcggaaaaattcggcaccgccgcgcctggcgaagaagcgggcgaaggcgacaaggaatgagcaagccgcgcagcaccaagcgccagatcgacggcgtgctgctgatagacaagccttacgacatctccagcaacaacgcgctgcaaaaggcgcgctggctgctgaacgccgccaaggccggccataccggcgtgctggacccgctggccaccgggctgctgccggtgtgcctgggcgaggccaccaagttttcctcgtatctgttggacgccgacaagggctaccgcgccacggtgaaattcggcgcggtgacgacgacgggcgatgtcgagggcgaagtggtgtccgagcggccggtcagcttcagccgcgaacagctggaagccgcgctggcgtcgttccgcggcgaaatcagccaggtgccgccgatgtattcggcgctgaaacaccagggcaagccgctgtacgaatacgcgcgcgccggcatcgaagtgccgcgcgaggcgcgccgggtgaccatccgcaagctggagctgctggccttcgacggcgtgtctgccgaaatcgacgtgctgtgcactaagggcacctatatccgcaccctggcttgcgacatcggcgaagccttgggcagcggcgcgcatttgaccgcgctgcgccgcaccgccaccggcggcttcggcctggacgaagcgcacacgctggcggcgctggaggcgctggagatggccgggcgcgaagccttgctgctgccggccgacgtgctggtgcaacattttccggaaaccgaactggccgacggcgaaatcggcaagttcatgaacggacaagccgtgctttttgctgaaaagtgtgagaaaatgcagcgcttccgggtataccaaaagtctacccggcgcttcatggggctgggcgaggcgcgcgacgatggtcgcctgcatccgatccggctcctggccaaccaggcggcaacgtcctgagcggcaaactaccggagtgtggaatgggttggttttccggctcgccgcacttgtcgggttttcaaaccccctaaatgaaactggagtaatccaaatggcaatgaccgccgaacaaaaagctgaaatcgtcaagagcttccaacgcgctgaaggcgacaccggttcgtccgaagtgcaggttgccctgctgaccgcgcgcatcaacgacctgaccccccacttcaaggccaacaccaaggaccaccacagccgtcgtggtctgctgaagatggttagccgtcgccgccgtctgctggactacctgaagaccaccgacgctgacgcttaccgcgcgctgatcgcccgcctgggcctgcgcaagtaatcggcaacggttctgaaaaagtcgcagcttgctgcgactttttcacaccggcagcaaagcgggccatattgtcgtaacaacggggggagcctctaagaattccgatctatcgtgcaggtcagaatttttaggggttcccgttgttttttccggctcgcgtgttttgataatcgaactcaagatagggaaaccctcgtgttcaacaagatcaccaaatcgttccagtacggccgccacaccgtcaccctggagaccggcgaagtcgcccgccaggcatccggctccgtcatcgtatccgtagacgacaccgtagtgctggtgaccgtggttggcggcaagtcagtcaagccgggccaggacttcttcccgctgaccgtagactacctggagcgcacctacgccgccggcaaaatcccgggcggcttcttcaagcgcgaaggcaaacagtcggaaaaagaagtgctgaccagccgcctgatcgaccgtccgatccgcccgctgttcccggaaggcttctaccatgacgtgcagatcgtcgccaccgtgatgtcgctgaatccggaagtggattccgacattccggcgatgatcggcgcttccgccgcgctggccatttccggcctgccgttcgccggcccgatcggcgccgcccgcgtcggctacgccgatggcgaatacatcctgaacccgaccaagaccgaactgcaatcgtcgcagatggacctggttgtcgccggcacccagcgcgccgtgctgatggtggaatccgaagccaaggaactgtccgaagccgtgatgctgggcgccgtggtgttcggccacgagcagatgcaagccgcgatcaaggccatcaacgaactggccgacgaagtgaacccggtgatgttcgactgggccgctccggtagccaacgaagagctgatcgcccaagtgcgcggcatcgccggcgccaagctggccgacgctttccgcctgcgccagaagcaagcgcgcaccgtggtcatcaacgaagcctgggccgaagtcaaggctgcgctgatcaacgaaaccaccgacaccttggtggccaacgagatcaagggcatcttcaagggcctggaggctgaaatcgtccgcggccagatcctggcaggcgaagcgcgcatcgacggccgcgacacccgcaccgtgcgtccgatccgcatcagcaacaatgtgctgccgcgcacccacggctccgcgctgttcacccgcggcgaaacccaggcgatggtcgtgaccacgctgggcaccaagcaggacgaacaaatcatcgacgcgctggccggcgaatacaccgagcgcttcatgctgcattacaacttcccgccgtactccaccggcgaagccggccgcatgggtccgccgaagcgccgtgaaatcggccacggccgcctggccaagcgcgcgctggtagcggtgctgccgccggaagacgaattcggctactcgatgcgcgtggtgtcggaaatcaccgaatccaacggctcctcgtcgatggcttccgtgtgcggcggctgcctgtcgctgctgtccgccggcgtgccgctgaaggcgcacgtggccggcatcgccatgggcctgatcctggaaggcaaccgcttcgcggtgctgaccgacatcctgggcgacgaagaccacctgggcgacatggacttcaaggtagccggttccgcttcgggcatcaccgcgctgcagatggacatcaagatccagggcatcaccaaggaaatcatgcaggttgcgctggaccaggccaaggaaggccgtctgcacatcctgggcctgatgaaggaagccgtggacggcccgcaagaactgtccgcccacgctccgcgcctgtacgtgatgaagatcaacccggaaaagatccgcgaagtgatcggcaagggcggcgaaaccatccgctccatcaccaaggacaccggctgcgagatcaacatcgaggaagacggcaccatcaccatcgcttcgatcagcaacgagggcgcggaagcggccaagaagcgcatcgaagagatcaccgttgaagtggaagtgggcaaggtgtacgaaggcaccgtggtcaagatcctcgacaacaacgtcggcgccatcgtttccatcctgccgggcaaggatggtctggtccacatttctcagatcgccaacgagcgtatcaagaacgtggccgactacctgaaggaaggccaagtggtgaaggtcaaggccatcgaaatggacgaccgcggccgcatccgcctgtccatcaaggccctgctggaagaagaagcgaaaaccgcccaggcgaccgctgattccttcggcctgaagacccagtaagcagtttgccgccatcctgcggggtggccggactcaaacgacaacccccgccccggcgggggttttttcgtgcgtgggctgggatgcggcgatgggcggatttcgaaagcgccatgttaaaatgccgaaaataaattttatcgtatgattttggtattaagtggcgggtcggaggcagagagaaagacgcgatggatgtggcggagcctgaaaaatacttgcgcgagctcggattgttcaagcaaatgctggcgcgcatcagctggaaaacgcgcggtagcccgatctacatttcagccagcatgggttttgacgagctgaccactgttttcgaacagtactatgcggcatacggcgcgccatctcggcgctagtaagcgcggctaggctggcgactgcgctgtggcggcacgctcggatctggcttgccgatcaatttgtttgttgcttgggcctgcttgtcaggaatggcgggttgggatggaatggcgggtttggcgcgggagatgcggtgcgggttgaggatgcggagaaagcttgcgctgagggcaggtcgctggcgatgcgcatcattgtatttgtgcctggcgtggttttcgcttggtgtttttacggttttgtcctgttcgtgatcggcatcggctatatgaatccgcgtttgccccagtattatggggcgatctcgctgttcacccagttcctgcccttgctggtcagcatcggcagttggctggtctggatattgacgctgcggctgcgctggctgaaacgatgcgtcgccgcattggctttgctggcggcgggaacggttttcctgcagcagatccagcattatctgccgcctgggccggatagggagcaggctcagcttcagcaaatggagccttagaggattagcctcgttcgctgcatgagttggctagcgaccatcgcagtgcaaggaagaggtgcatctttagaggaggcaaccattgtggcgcggatttggccgcaggtgagttaatttgataattttaaaccgcgctttgtttggcctgcatgtatatctggggtgtgctgaagcgaaggagaatgatatgagacactcggcggaaagtgtactcaggactcttgcggatcacgttcgatcaacttctggatgctttatcaaaattgggccagagttagcgggtaccaatgagacgcaagaaaagcaaggtcaaatattactgctcgcgaccgagttggagaatcttgccaacaacgcagcggaaggtcatgcaatttcttaccgccaatttgaaacggtactgcagcagttgcataagcttggcttctttccagaggccggacttgtttcacagattgcccaagccctagtaagttcaggagcttttgacgatgggcagcacttgtcctgagggttgaccggcgggtgagcctggcatgtgaccgagaaggaatggttaaggttagcgaggtagcgggccatgttggcgacatggcccgcaagcggtcgctcaatgttttagcagcggccgcagtttggcgcgggcgtcgcgcaggatgtcggcggtggtgttccagtccacgcagggatcggtcaccgagcagccatagcgcagctcggccaggttggccgggatgggttgattgcccggctcgatgaagctttccagcatgaaggcgcggatgctgcggttgccgtggcggatctgggataccgcgtcggccagcacgcgcggctgcagcgtgtgctgcttccacgagttggcgtgcgcgcagtccaccatgatggccggcgggatgtcgtgcttcttcatcgcctgttcggccagcgcaatgctcaccgaatcatagttgggccggccgccgccgccgcgcagcaccaggtggcagtgcgggttgccgcggctgttcaccaccgccacccggccgtccttgcccatgcccaggtaggcgtgcggcgcgctggcggagacgatggcgttcagcgccgcgtccagcgtgccgtcggtgctgttcttgaagcccaccgcgctgtccagcgccgaggccagttcgcggtggatttgcgattcggtggtgcgcgcgccgatcgccgtccagctgtagaggtcggccaagtacagcggcgatagcgggtccagcgcctcgccggccagcggcaggcccagttcggcggcggccaagaggaagcgccgggcgatgtgcatgccctcatcgacgcagtagctgtcgtccatataggggtcgttgatcaggcccttccagcccacgctggtgcgcggcttttcgaagtaggcgcgcatcacgatcagcagcgtgtcgtccagttcggcggccagctccgccagccgggcggcgtagtccaggccggcgcgcgggtcgtggatggagcaggggcccaccaccaccagccagcgcgggtcgctgccgttcagcactttcttcaccgcgtcgcggccggcatggaccgaggcgctggcgcgcgcgctggccggcaggctgcgcaataattcggcggggctggccatcgagcggtagtcggcctggctggacggcggcgacgcgtggccgtgttcgggcgcgagtaggccgtgttccggcctggcaagcgtagtcatgatgttctccacaggatgatccgcaaacgagccgcggattcagcccgtcgtttgcggcagggccggcgcgcggccccggtgtcggcgacagggcggccgcgcgccggcggcgcgcaggcctgcttttcgtcgcggcggccgcatgctaggcggccagggtggcgccgccgtccaccacgatgtcctgcatcgtgacgtggccggccaggtcggaagccaggtacagcaccgcgccggcgatgtcggccggggtggccagcttgcccagcgggatgcccaggcggaacgcttccggcttgccggcgatggtgctggcggcgccgtgctcgtcctgccacatgccgcgcagcatcggcgtgtcggtggagccgggcgacaccacgttgcagcgcacgccgtacggcgccagctccagcgcggcgttgtggctgaggctggccatcgccgcctttgacgcgccgtaggcggccatggctatgcgcggcacgtgggcggcgttggaggcgacgttgacgatggccccggcgcggcgcgccttgaagtgcggcatcagcgcgcgcagcaggtagaacggtccgctgacgttgacggccaggcactgctgccagtcgtcgaccgacagcgcgtcgaacgcgcccaggcgcagcacgccggcggcgttgaccagcacgtccggcagcgcgtcctcttcggccaggcggcggcacagcgcggccacggcgtcggcgtcgcggatgtccagcggcagctcgcgcatcacgccgcaatgcgcggccgcttgttcgaactgcaggtccagcgccacgacgcgcgcgccggcctcgacgaagcggcgcgccacctcctggcctatgccctgggccgcgccggtcacccacacgcattggccggtgaaatccagtccgaccatgatcaggcctcctgcggcagcttggcctcgatggcggcccaccagccgtccagcgtcaggtcctgggccaaatcttcgaagccgatttccaggcccagcttctgccattgcgccaccagctccatcacgcggatggagtccaggccgtagtccagcaggttgtcgccgccggccaggctgtcgtcgccgtcttccagcacggtcagcacctgggccttcagccattcgcgggtcagcgcggcgtcgccgccggcaaccgctaggtcggactgcgagatcaccgcgccgcagcgggtggccacgtagcgcagcgccatcttgtgctcttcctcgctgaagtccgccaccgcgtcgccgaccatgaaggcctggatgtcgcgcatgaaggcgtcgcaggcggtcatcatgcagccgatgtgggcgtagacgccgcagatcaccaactggtcgcggccccaggcttgcattctttcctgcaggtcgctgcgctggaaggcgctgtagcgccatttgaccagcacggtgtcctgctcgcgcggggccagccgcggggtcaccacttgcaccgccggatcggcggtggtcaggcccgggccccacatatcgttcagcagcgcgcggtcttccggcttttgttcggtgggctgcgcggtgtagatcaccggcacgccgtggctgtcggcccagcggcgcagcgcgtccactttggataccagttcattgaccagcgcgctgtcctcgccgtagaaggccaggaagtagcgctgcatgtcgtggatcagcagcgcggcgcgcttgggctccacgcgccagtcggtcttgttggcggggaagtcggccgcctgcggcagcgggtaggcgttcagcttgggaatgctcatggtgttcaggctccggccgcggcggccagcatgccgcgcagcgcttgtttgtctattttgccgacatgggtcagcggcagggtgtttaccagttcgaaacggtcgggcagcttgtagtcggccacgccctgctcgcgcaggaagcggcgcagcgccaccgatttcagtccgtcctcatgcgccaccacgtaggcgcagctcttctcgcccagcatcgcgtcgggcatcgccaccagcgcggcctgggccacctgcgggtgttgcagcagcaggtgctcgatctcctcggcggcgatcttctcgccgccgcggttgatctggtccttgacccggccgaccacgcgcaggtagccgcgctcgtcggccaccaccacgtcgcccgagtaatagaagccttcgttgtcgaatacgcgggcattgtgttccggggccaggtagtagccgcggaaggtgtaggggccgcgggtggccagcatgcccggcgcgccgattggcaccgggtggccggcttcgtccaccaccttcacttcgtcggcgtcgctcatcggccggccctggcagccatagacgatgtcgtcgccgtcgtccaggcgggtgtagttgaccaggccctcggccatgccgaacacctgttgcagcttgcagcccagcacttccggcacctggcgggcggtggcttcggcgaagctggcgccgccgacctgcagcagcttcaggctcttcaactgggattcgcggccgggcgcggcttgcagccacagcgcgacggccggcggcaccagcgcggcgatgtccacctggtggcgctgcaccagcgcgaagcaggccagcgcttccggattaggcgccaacaccaccgcgccgccggcgtggaacacgccgagcgcgcccggcgagctgagcgggaagttgtgcggcgcaggcagcgcgcacaggaagcgggtatgcgggccgagctcgcagatttcggcgctgcggcgcacgctgtagaagtaatcgttgtgggtgcgcggaatcagcttgggcgtgccggtgctgccgccggacagttggaagaacgccacttcgtcggcggcgctggggccggcttgctccggcaggccgccgcagtcccgctccagcacggcttccagctcgtcgttggcgaacaggcgcacgctcagcgccggggagatggccgccagttcgtccgccatcgcgtcgtcgccgaacagcgggtggcggcggtcggcgatcagcagcttgggctggatctggcgggcgtaggccgacagctccagcttctggtggctgaacagcgcgttgaccggggcggcgccgatcttgaacagcgcgaacagcgcgatgtagaactcggcgacattgggcagctgcaccagcgcggtgtcgtggcgggccacgccgcgcgccagcagccaggcggccaggttgcccgcgcggcggtccagctcggcgtagctgatctcgcgctcgccgcacagcacggccggcgcgtcgggacgctcgcggcattgccgggccagcatctcggtcatcggctggtcgttccagtagccggcggcgcgatagcgcgccgccaggtcgtcgggccagcgggtgaaggctacgctcatgccgccgcctcctggccggacaggccgaaggcgcccagcatggtgcccagcttggcctgggtttccgcccattccgactccggggtggacgcggcgacgatgccggcgccggcgaacagccgcacgcgggtatcggccacggtggcgcagcgtatggtcaccgcccattcgccgttgccatgctcgtcgcaccagccgacgatgccgctgaacacgccgcgctcgaacggctcgatctcgcggatcagctggcgggaagcctgggtggggaagccgcagatggccggcgtcgggtgcaggcggcaggccagctgcaaaatcggcagcgaggcgtcggcgagcacgccgtctattggcgagcccaggtgccacatcgcgcgggtgcccagcagcgacggcgcggacgggatggatagctcggcgcaataggggcccagcacgttctggatgtcgtcgatgaccaggctgtgctcgtaatggtctttggacgaatccagcagcttggcgctggcggcggcgtcggccgccgggtcgctctggcgcttggcggagccggccagcgggaaggtgcgcacgcgcgcgccttccttctgcagcagcagctcggggctgacgcccaccaggcggccgccgcctgccagcggcagctggaactggtagccgttggggttttgcgcgcagacggcgtcgaacacgcgctccgccgacaccgggcggtcgaagtccacttccagcacgcgcgacagcaccgccttgcggatctcgccgcggccgaagcgctctatggcctggctgacggctgccttgaagccttgctcgtccgggatgctgcgcgagccgaccaccttgccgccgtcgccggcgcgctgggtggcagcctgcaagcgttcttggcggtcgaagaaggcgtggcgggcggggatgaagagttcggacggctgatcgatgtcgaaggggatggcacccatcagcaccggggaggcgatgccgtcggcgcgggcgcgggcgaaggcttcggccacttcgcgggaaaaggcgctgccggcgtcgagcgcgccgcgcgcgggggtatcgattcgggagtgtatgccgccggccttcaggctgcggtgggacgacaggaaataaaactcgccgtcttcggcgttgccggtcgcggccgactgggtgtgcatggcttaactccgatgataatgataataattatcgttcaaggtatattcaaagcagaaggttgtcaactggatgctgccgattccatgcgttgggaatagcgtaaagtcagggtatttgggggttgatgggcgtgaaaaagcacgatcatgaatggatttggcatgatcgtgcggggtggcgcggcggcggccgcgccggattgaccgcgttaaatagattgcaagcggcgggccagctcttctcctatgcggcgcatcggttccggatcgctcatgccgaagtggtcgcagtccagctccacgcagtccaaccggccttgcagatagggctgccagtcggccggcgtcggcgcgtcgccggggtggcggccggcgcggaacaacagcacgtcgccggcgtaggccggcgtgcggctgtcgcggaacaggcgcatgccgtgcaacgaggcctggcccagtttttccagcgcggcgcggcccagcggcgccagcgggctgccgggacgcagcaggcgctggtagatggcctcgttgtccagcggcagtccgtcggcgtcggcgtccacctcgccgttgacgctaagcaccgtcaccaaggcgtcgtgcaattggggttgcggccgcgtttcccagcaggcggcggggtagctgtccatcagcgccagcagctccacggtttcgccggcggcggcgagcgcggcggccatcgcctgcgccagcgcgccgcccagcgaccagcccagcagccggtacgggccgcacggttggacggcgcgcatgcgggcgacgtaatcggccaccatggcgtcgaagctggcgggcgcctcgccctggatgccggtggcctgcaggccgtagatggcggtgtccggcaggtggcgcgccagtcccagatagcaccaggacaatccttccgccggatgcaggcagaacagcgcgggcagcttgccgggctggatggtcagcagcggcgcgaactcgccgccctggctcgctgatggcggacggtgggcggccggcgcgctcagcgcctgcgccagcgcggcgacggtgttgtagctgaatagcgccgatacggcgacttcgcgctgcagcagctgggccagccggttggcggcctggatcgcctgcagcgacttgccgcccagcgcgaagaagttggcgtgcgggccttccggcatgcggcccagcacctggctccacacttccatgatctgccgctccagcggcgtggcctcggcggccggggacgcgtcgcgggccggggcatcgctcagcgcggccagttgcttgcggtctatcttgccgttgacgttgcgcggcagctgttccagccattgccagcggtcgggaatggcggcggcgggcagccgttcggccaactggcgccgcagcgcgccggcatccggctccgcgtcggcggcgaggaaggcggccagcgtgtagccgccgccggcctgcggcaagccgatcaccgcggcctcgcgcacgccggggcaggccagcagcgcgttttccacttcggccgggtcgatgcgcaggccgctgatcttcagctcgtggtccagccggccgaggaagcgcagctggccgccctgccagacggcgcggtcgccggtgcggtaggcgcgcggcgcgccgggcagcgcgtccagcgccacgaagcggcgggcggtcagctcgtcgcggcccaggtagccgatggccagcgcgtcacccagcaggcacagctcgccttcctcgccctgcgccaccggttgcaggccggcgtcgacgatggcggcggccacgccggggcgcggcaggccgatgggaatgtcgtcgccgccgtcccacaccgcgtccgggccggacagcgcggcgccggtggcgatgatggaggcctcggtggggccgtagctgttgagcagcgtggcatccggcagcagctcgcgccagcggcgcgcgcgctcggtcagcgcggcctcgccgccgatgatggcgaggcggacgcgggacagccggccggccaattccggcgtcagcgcgtaagccagctcgtgccagaaggcggtgggcaggtccagcacgtctatcttcagccgcgcgacggcgtcggcgaaggccggcatcgattccagcatcgcgtcgtcgcgcaatgccagcgtgccgccgtggcacagcgccaggaagatttcctcgatgctggcgtcgaaatgcagcggcgcgaactgcaggatgcgctcgccggcatggacgcggtagaactgcccggcgctggagacgaagtgggccagcgcgcggtggccgaccagcacgccgttgggcttgccggtggagccggaggtgtagagcaggtaagccgggctgtcgacgccggcggcgcaagcgtccagacgcggcgcgtcttcgcccggcgcttcgtccaggcacagcgccggcgcgtcgccgcatagcgcggcccagcggcgatgggtcagcgccagcctggggcgggcgtcgtccagcaccatggccagccgggccgatgggccgagcggatcgagcgggacatagcagccgccggcccacagcgtgccgaggatggcgacgatggcgtccaccgagcgcggcagcaggatggcgacgcgatcgccgtcttccaggccctgggccttcaagcggccggccagcgcgcgcgcgcggtccagcaactggcggtagctgagggcctggccttcgccttccagcgcgaccgcgtcgggctgcgcgacggcctgcgcggccagccgctccatcaccgggacagcgggccgttccagcgccgggccttgcagaatggacagcggcggcaagtccggcagcaagctcgccagcggcgtgccgggctcggcatgggccagttggtccagccattgcggcagctcatgccacagcgcgtccagccgctcggccggataggcgtccggatgggcttccaggctgagccgccattcggtgttgagcaggctgatgttgatcgacagatcttccaccgggccggagctgatcggccggatgcgggttttcaggccgtcgaacggcgcgtggcggtcgaagggcatcaggttgagcaccgggccgaacagccgctggcggccgtccagccggcccagatcgccgcgcagccattcgtagcggtagcgctggtgggggcggatgtcgcgcaggccggcggcggcctggcgggccagctctcccaggctggcggccgggtccagccgcaggctgaacggcgcgatgttcatcgccatgcacggcacggccagcgcggccgagcccatgcggttcatcaccggcaggcccagggtgatggcgcgccggccgctgcggcgtgccagccaggcagcggtcgccgccatcagccaggcggcccagttgacgccgcaggccttggcggcgcgctgccaggcgtcgatctggcttgcggtcagcgcgcggccggctttgcgcacgctgtcggccagcggttgcggcggcgccaatgtggcggcgggagggaaggcttgttgccgcgcggtccagaacgcgcggtcccgctcgcgctgttcggacgcttggtaagcctggtcttcggccagcaccggctccagccgccagtcgggcagcggcggcgcgtcctggccgcgttgggcggcgttgtagcgcgcggatacggccttggccagcaggccgtaggcgaagccgtccagcgcgatatggtgggtttgcacataccacagaaaacgatgaggtcccagttgcagcagcgcgctgcggtgcagcgggtccgccgccgggtcgcaggggcgggacagcgcttcgcgcatccaggcatccgccgcggcttcgggatcggccgcgccgctcaggtcgtgccagggcagcgcttgcgcgggggcggcttgcgggcattgccacagctgttcgccgtcgaattcgaagcgcatgcgcagcgccgggcagtgcgccagcgcggcggcggcggcggcgcggaaggcgtcgatgtccagcgggccgtcaagctcggtggcttcggcggtccagtagcccggattgtcgggcgccagccgctgccccatccagatgccgtattgggcatggctgacgggaaggcgcgtgggagtctcggtcatggggatgtctgcctgttatggttgcgggccgtttggcggcctctgagcgaaggctgacatcataaatgcgattgagtatcaatttcaatgtgattgtggcggcgggacggcagccggctgccgtccccggctcagcggatggcggccaggccgtccaccagcacgtgcggcacgccttgcgagcagcgctccacccggccgttgacgccgtagaccgcttgcagcgtggcggcgtctatcacctggtccggatcgccgttggccagcagctggccggctttcagcatcagcgcccggtcggcgtggcgcagcgccgcgttcaggtcgtgcagcacgatcaccgtcaccatgccgcggcggcgggtttcgcgccgcagcaggtccatcacgtggaactggtaattcaggtccagcgccgacagcggctcgtccagcagcagcaccgccggctcgcggatcagcgcctgggcgatgcccaccagctggcgctggccgccggagagctggtcgaggaagtgcagcgccaggtggtcgatgcccagcgattgcagcagcgcgaacacctgctggtcgtcgtggcggcggaacaggccggcggcggtggcctggccggccaccatcagcgattcgaacactgtcaggtgcacgctgggcggcagcgtctgcggcaggtaggccacctcgccgcgttggcggctgagcgggcggccgcgcaggcggaccaggccgtcgccgccctgcaggccggccagcgcgcgcagcagggtggacttgccgctgccgttggggccgagcagggcggtgacctcgcccgcccgcatacaggggacggacagcttgtcgatgacgcggcgcttgccgtagctgaccgacaggttctcgatggacagctgctcgctcatgtccggcctccgttgcgcaagacgatgacgatgaagaaggggatgcccaccagcgcggtgacgatgcccaccggcacgatgacgccgggaatcaggttcttggtgaccaccgaggccatggacaggatggcggcgccggtcagcgcgctcaccggcagatagaagcggtgatcctcgcccaccagcctgcgggcgatgtggggcgcgatcaggccgatgaagcctatggtgccgacgaaggccaccgccagcgcggtgagcaggctggcgcgcagtagcgcggtcagccgcagccggcgcacgtcgatgccgaagctggcggcgcggtcctcgccgaggcgcagcgcggtcagccgccaggcgttggccagcgaccacggcaggatcagcgcgaaggcggcgaagatcaggccgatcttgggccagtcggcgcgggacaggctgcccatcagccagaacaccaggtcttgcagcgcgtcggcggtggagacgaattgcagcagcgacaccagggcgttgaagctgaagaacagcgcgatgccgaacagcaccacgccgctggcagccatccgcgtccagcgcgccaccaggttcagcagcagcgccgagcccagcgcgaacacgaaggcattgaccggcagcatccacgacgcgggaatgccgggcaggctgatgcccagcagcagcgccagcgccgcgccgaaggcagcggccggctgcaggcccagcgtgaatgggtcggccagagggttgtgcagcacggtctgcatctccgcgccggccaggcccagcgccaggccggcgccgacggcgatcagcgcgtagggcaggcggatgtcccagacgatgacggcggtggccggatcggctgcggacggttccagcagcgtgcgccagaattcggccagcggcatgccgctggcgccggtggtgacatccagcgacagcgacagcgccagcagcgccaacaggccggccaccagcagcagccggcgcagcagcgcgcggcggtagtcgccgctcaccgcggcggcggtgagcgggggcagggtggaatcgttcatttgcctcccttgacccagtaggtgccctgcggcggaatcgccaggaagtcgcggtgcagctgctgccagctggcgtccgggtccagtttggcgaagcgcgccggctgcagcgtcttggcgaaggcttccagcagcacgatgtggtagggcgtgttgtagaagtggtgccaggcgccgaaggtgcggccgtcgcgcacggcggcgagcgcgcccaccggtttgcgcgcggcggcgcgggccagcgattcgcgggcctgggccggcgagatgtcggcgccgaactggatgccgatcttgtcggccgcgtcggcggtgccggtgccgatgtaccagtcgggtttggaggccagcacgtgttccatgttcacctcgcccaccgcgccgggaatcagcttgtcgccgatattgacgccgccagcggcatccaccagctcgcccaggctgcctttgccggcgctggtgacgttggggaaggcggcggcgcgcagatcaaggaagacattgggcttctgctgcgccgggatggcggccaccgtcttgcggatggcgtctatccggctttggtaaaagcggatgaagcgctcggcctcggcctcgcgctgcagcgccttgcccatgatgcgcaggctgggcacggtgtgctccagcggcgcgttgcggaaatcgacgaacaccaccggcactttggccgcctgcagctgctggacgatgggattgttcaggcccggaccgtggccggaaatgctgaagatggcgatgtccggcttcagcgtcagcaccttctcggcgctgaccgagttttcgctggtcttgccgatcagcgggatgcggtcgatctccgggaagcgtttcttgtattgggcgtaggtttgcgggtccagctggcggaaatcgccctgccagccggcgacgcgggccagaggctgcttgccttccagcagcgccagcgagtagaacagccggccttcgcccagcaggatgcggttcaccttggccggcacttccaccttgcggccggcgatgtcggtgatggtggcggcctgggccgacagcgcggtggcggcgatcagcgtggcggccagcaaacgggagaatacggtcttcatcgggcgtcctttacttttgccagtcgagcttgagttccggttgcttggccatcaagcccaggtgctcgtccatgatgaattcgatcttggccagcttgtcggccgcgtccgccgcgcacaccatgtccagcgtgtcgcccgcgcgctggatgtcgcaggtgccgatggggaactgcacatgggcgcgctcggtgtcgaaatccaccggcaccttcagcgcgtagtgcttgcacagtttgtacagcaccttgtcggcgttggcggtggtgagggaagcgcggctgctcagcatgatgatttctccattcttttaaaacgggaacaggcagttggcggaccgatggggtccggcaactgccgtgcgtagcttcccgtccgcttttgcggtgcggatggggagcgcggggtttagaacttgccgctcagggtcagccaatagcggcggccctcgtcgaccatccagttgccgtccaggccgttgtagcggcctcgatcatcgatggccaccttgcggtcgccgacgttgaacacggcgaaattgacgtcgaaggtcttgttgatgcggtaagtgccgcccaggtcccaggtgctggagccgccacgagtgcgggcgacgttggcgccgttgcggaagccggtgtagtactgcttgccttcgaagttcaggcgagtgtacagatccagcttttccatcgggttccaggccagcttggcgttgcccgcatgctcaggcgttttgtccagcggcatgccatccagagactggccgccgaaactggtttccttgccgccgtggcgcttggacttggtgtaggtgtagttgccggatacggtccagcgcggcgcgaacgcccagctgccggagagctccaggccgcggatgttcacggagtcgacgttgtcgtagacgtagatgcgagcgggtgagataccaggatcgtattgattggagaatttatccgttccgtagctgaccaccttgttcttgaagtcgttgtagaacagcgtggcgttggcgctcagatccttgttgttatcgaaatgcaggctggcctcgtaggaagtgctttcctccggcttcagattggagttgccgcacagaacgcctgcttcgttgcctgccccggtgcgcatgcagtagccgccggtgctctggcggatggtcggggccttgaagcctttgccggcgccgcctttcagagtccactgcgaattcagttgctcaaccaggtacagacgcggcgtgaaatggctgccaaacacgctgtggtggtcgagacggccgccgccggtgagcttcaggctgtcggtgatgtcgtaggtatcttcggcgaacagtgcccaggtattgacggtgatcttgttcggattggccggcccggtgaagccggcaatggcttcctgggcgcgcatgttgtcgccaacctgctggccgacttgggtgccgagtttcagtgtgtgcctgtcgaacaggaaggatagctggccatccaacgtggtgttggtcagcttcaggcctttgccatcgtcgatattgttggcgctgtggctgggcttctcgatttcctgatacagcgcgacattggagcggatgatgccgtatttgccgttgtggctcaggctccagtgatccctggtgtcgaaatagtcgtcttttgtattcggtccaaagcctcccttgacttttattagggaggccacgctcttgcccggcgtggtggtcttgcgcagctcgttgtgccctgcctcgaacgtgatctcattgtccttgttcggggtaaaggtcagtttggcgttgatgtctgaggcgtgagtcgcaactttgcctccatcgccgctgttggagtagtagatgttgtcttcggcctggttgttcagcgcgccgtagatttgcagcgacagcaggtctttcaccagcgggccgccgacccagaagctgctctggccggtattgccttcatctgaatgctgggtgatggtgccgcccagcgtcatcgaaccgtgccattccttcggcgccttgcgggtgatgatgttgaccacgccgcccatcgcgtcggagccgtacaaggacgacatcgggccgcgcaccacttcgatgcgctcaatcgcctccattggcggaatctggtactgctggaagccgccggtgccgcggctgcgggattcgcgggtgttctggcggcggccatccactaggagcagcgtgtattcgccgggcatgccgcgaatggaaatgtccttgtcccccggaccggaaccgttgatgttgacgccttccaggtcgcggatcgcatcggtcagattggtgaacggcttcttttccaggtcttcgcgggtgatcaccgagatgctggccggggcttccttgatcttctgctcgtagccggaggcggtcaccaccaccgacggcagcaccgcttcggattcggcggcgaaggccgcgggaatgtgcaggctgcctgccgcggcggacagcagggcgagacggaaaccatgcctggcgacggcgcgaggcgggaggcgattttttttcattttgattacccagagttcatcacggaacgtatgtccacttggcaggcgcgctgcggcgatcgttgctgcgtttttatggaataaatgcgcaatagaatgtcaaatggcccgctattttcgcattaagtctattttgtgtaaataggaattgttttcattatcgttggcgcgacgtagtggcgaggttcgcgcgcgtgaaaaccgccgccatccaggacaccggcggcggctgtccgccgcgcgccgcaaatctggatgcgcttgccttgcatcaagcaggcgtgtcgataccgcttgcataccacctctaataccacttaaatgccaaatgtcattcgcatgatggtcgcgagtggaaattccagtgggacgccgcatggcggcccagctcatggcgcagtgcataaacggggagtggatgatgagcgtgaagcgattgctgggcgcggccgcgctggccgcggcgacaacggcggcgtgggcggcgccggacgcggcggctttggggcaaagcctgtcgatgcgggtggcggtggacagcaacagaggcgcggcggccggcgcgccgtgttccgacctgggcgcggactgggcgtcctgcctgaaagggcggctgattctggaaaaccagggcggccaggcggtgccggccggcggcggctggagcctgtacctgcacagcatccgccgcatcctgaagctggatacgccgcagttcgccatccgccacatcaccggcgacctgtaccaggtgacgcccaccgccgctttccagggcctggccgccggccagcggctggagctgccgctgatagacgaatactggatcctgcaggaaagcgatgtgctgccgcgcccctacgtggtggtggacggccaggcgcctgccttgttggcgcacgatggcagcgacgaggccagctacttgctgccgctgcgcggcgacaactggaagaacccggccggcgagctgcggccgctggccacgccgcagcaacgctatctgacattcacccagcgcggtcagcagctgtcggccgcccaggtggccaaccgcgtcatcccggccgcgctgcggcagcagttgggcggcggccagctggaggtgaaagggctgagcctgagtctgtccggcctgagcccggcgcaaagccaggcgctgtcccagcgcgcggcgcaattgggattgcggccggccgggggccgggtggcgggcggcgtggtcggtacgcggctgccggccgatatcgccgtctccggcggctaccggctgcagatcggccggcagggcgtgaaggtggaaggctacgacgccgccggcgtgttctacggcgtgcagacgctgctgggcctgctgccgcaaaacggcggcaaggcgcaatggatgacggtggaggacgcgccgcgctatgcccaccgcggcatgatggccgacctggctcgcaacttcaaacagccggccaccgtgcgccggctgatagatcagatggccgcctacaagctcaacaagctgcacctgcacctgtccgacgacgaaggttggcggctgcagattcccggcctgccggagctgaccgaggtcggcgcgcgccgctgccacgacctgagcgaaacccagtgcctggtgccgcagctgggctccggtccggccaaccagtccggcggcggctacctgacccgcgccgcctacatcgacctggtgcgctacgcccaggcccgcttcatcgaggtgattccggagttcgacatgccggcgcacgcccgcgccgccgtggtctccatggaggcgcgctatcgcaagctggcggcgcagggccggccgcaggcggcggccgaataccggctgctggatccgcaggaccaatccaatacgctgtcggtgcagttttacgaccgccgcacttatttcaatccctgcgtgccgggcagcgcgcgcttcgtcgccaagctggtgtccgaagtggcacagatgcaccgcgaggccggccagccgctgcagatctggcatttcggcggcgacgaggccaagaacatcctgttgggcgccggcttccaggacgccagcggcggcgacccgtccaagggcaaggtgaacatggcgcagcaggacaagccatggggccgctcgccggcttgcctcgcgcagatcgcccaggggcaactgagcagcgtggaccagctgccgctgaagtttgcgcagacggccagccgcatcgtcgccgagcaaggcatcccgacgatggcggcgtggcaggacggcgtggccggcgccagcggcgcgtcggacttcgccacccgcaacaccatggtcaccgaatgggacacgctgtactggggcgcggcgcaggcggtgaacggctatgccgccaagggcttccagaccgtgctggccatgccggactacctgtatttcgacttcccctatgagctgaacccgcgcgagcacggctactactgggcctcgcgcgataccgacagctacaaggtgttcagtttcgcgccggacaacctgccgcaaaacgccgaagtgatgccggaccgccagggccagccgttcgcggtgaccagcgccgccgcgccggcgcgctacgccggcatccagggccaggcctggaccgaggtgatgcgcaccgacgccgagttcgaaaccatggtctatccgcgcctgctggcgctggccgagcgcgcctggcacaaggcggcgtgggagcggccctacacggtgggcgaaacctaccagctgggcgtgacgcacctggtggacaaggcggcgctgaacgccgactggcagcagttcgccgcggtgctgggctggcgcgaagcgccgaaactggaacatgccggcgtcggctaccgggtgtcgatgccggcggtgcggaccggcagccagggccagacggcgacgacggaatggccgggcgcgcgcctgcaatattcgtacgacggccatggctggcaaacctaccagcccggccagcaggtgcaggcgaattactggcgcggcgtctcgcaggacggccgccgcgccggccgggcggagagcctgtccggacagtgaagggggcgcgggccagatgcgggtccgtgctatgaaaaccgcgatgtcttgtgcgggtgcgtttggaatgccagatcggtttggcaaagaaacggcgggcctttggctcgctgtttttattggcatgaatctttaaaaggcatgggcgcggacgcttgttgaatagctggcgcctgcttcatccggcatggctatgcccttgtgctagcatggttgtagtctgcggattcgcgcgatgccgagcatcccgcggagctgcttacggcggtggaaagtcggcttgccttgcagccagcaggcagaaccattcaggcaaatggcgacaggatggaatatgtcagagcgcgatagcaggcttcacggcagttggcggctgctttcttttgagctggagctgcaggaatcgaaagcgcgtacccagccatggggagccgacccaaatggccgcctgattttcggcgccgacggccggatgatggtgctggtgaccgccaaggcgcgcgaaccgggaggcaccgacgcgcaacaggccgcgctctatcgcactgtgatggcctataccggacgatatagggtggatgcggacagcttcatcgtccaggtggacagctgctggaacgaagcctggaacggcaccgagcagcagcgtttctaccagttggatggcgatgcgctggtcgtcttcaccgcctggatgccgaacccgttggcggcggacaatgcaatgggacgaggagtgcttgggttggtgcgggagtcgtccgggctgtgttcgcaatgagcctctggtctgccagagccaccttttcaagcaggaggcttcgctcatgtttttcaatgcatgtcgatgtgattgcgtggtgtgaaatgagactggcatcaatggtgacggcgcttctttgcacggcattcattggcagcgccgctgccgattcctttgtcgtaggtgtggaagaaattgactattacccgctgcatagttacgccaatggaaaattctccggctatggcagagacttgcttgacgcatttgcaaaacaatccggccattcatttacttacatgccgcttccagtttcaaggctgttccatacatttctgaatgacaattcgattgatttcaaatatccggacaacccgcattggcaagcggacatgaaaaaagggaaatccgtcctctatagcgatcccgtagtcaatgtcagcgaaggattgctggtgaagccggagaagatagatcaattgtccgaggattcgcttcaggctatcgtgaccatgcgagggtttacgccttggccttttgatcagaccatgcggcaaaagatcaataatggaagcattcgggtttatcaggaggattcgttcggcaaggtgatcgctttggggatgacggggcactacgacgcggtctatgccagcccgatagtcatcaactactaccttgatgtggtgattcacaagccgggcgcgctagtttttgataaaaagcttccctttgaaagcaatgatttttccctttccagcatccgccaaggagaggtgatcaagcaattcaatgaattccttgctaaaaaccagcctttggttatggagctcaagaaaaaatacaggctgactgacaaggcggttcaatgaattaaagagataggatgtaggttagtaggatggattccattcttttttgactggcggtttggctcggttatagattgggctgaatccaataaattcagtgtttactttgggatttataacgctcataatgattttcttggtaagcgttgagcttcattctattcagcctagcctagggcctagttaactctgcgttaaaaaacattacatgcattttgttcgttttggtgaatttatagctgcttttatgattacaggtcccaagcataatctattgcagatccgtttaggtgccggagtgcaagataagccggcttgcgagtgtttgccgcctaaagggggatgctgtcatgagccgttagtcgaagcagaggttattgctagcgtcgtgaagggcgtagttgaggccaatctgcggctaggcacagctcacacggttacacatattcggtatgttcagaatgacactaaacctgagattgtttatggctacttggcgttgaaaatcctcgagcatctgaagtctggtggtgtgtttgctgagggtaaggatgagttctagcagtaacggaaatgaaaaagccttcccatatcgggaaggcttttttacgagagtgggctttgttctctgctgaagataaaggttcacttctcctgtctaaacagcgccgggctgtgctgtaggcgggtggtggcgatattgccgccgccgctgctggcgctgccgggcgcggcgaaacaggcgacagcgccttccacttgcagcgccatcgtctggccgggctgcgggcagcggtggccggggacgcgggcggccagcaggctgccgtcgtccagcatcagccgcacgctggcgtcgtggccgctgaagctgacgtccagcactttcgcctgacgcgcgtggtcgggcgatgccggcagcaggcggatttgctccggccgcagcagcacattgacttcgccttgcggcatgccgtccagcagcggcagccgtcccagcgcgcagtgggcctcgccgccctgggcgcggccgggcagcagcaccgcgtcgccgacgaagtcggccagttccgggctggccgggcgctggtacagcgtttgcggcgcggccacttgcagcagcttgccctgccacagcaccgccacctggcggcccatggtcagcgcttcggcctggtcgtgcgtcaccatcagcgcggtggtgccgctggcggagagcgcgtcggccaccgcctggcgggtttcggcgcgcagcgcggcgtccagcgccgagaacggctcgtccagcagcaccagcgccggcttgggcgccagcgcgcgcgccaaggcgacgcgctgttgctggccgccggacaattgctgcggcgcgcgggcggcgaagtcggccggcaggcccaccatgtccaagagctccgccacccggcggcgttcgcggcgctcggcgcgcggcaggccgaagacgatgttgtccgagaccgacaggtgcgggaacagcgcgccttcctgcggcacgtagccgatctggcgcttctccggcggcaggtacagctgcgggctgctcactagccggccgccgatgtggatgctgccctcgtcgcagcgctcgaagccgcacagcagccgcagcagcgtggtcttgccgctgccggacggccccagcaaggccagcagcgagccttgttcgacggtcagggtgatgtcgtccagcacccggtgctcgccgaagcgcttgcccagcttctctattttcagttccgacatggcggatcttcctgttgattccatggttgcggctggccgcccagcaccgcgccgcgtcccaggcaggacatcagcagccaggtggcgagaagcgacagcgcgatcaggatggcggcgtacggcgcggcggcggcgaaggccagcgcggcggtgtcggcccatacctgggtggccagcgtctcggtgccgatgggcgcgagcagcagcgtggcggtcagttcggtgatgacggagacgaataccaggctggcggcggcgcctagcccgggggccgccagcggcagcaccacccgccacagcgcctgccaccagttgagccccagcgaacgcgccagctcttccagcttgttttccgcctgcatcaaggcgctcctcacgctgaccagcgccagcggcaggaacatgatggcgtaggccagcgccaacatcagcgcgctctggtacagcggcttcagccactggatggctaggttgaccagcgccagcgcgatgacgatgcccggcacgccctgagccagatagaccacccgctccagcaaatgcgccagccggccgggatggcgcgccagcagatagcccagcggcagcgccagcaccgtggtcagcgcggcggcggccaggcccaggcccagcgaggtggcggtggccgacagcaagagctgcggcgacacctcggccggcgtcaccgcgtccgcgcctggttgcagcgtccagtacagaatggtggcgatgggggccagcagcgtgaccgagccttgcagcaccagccacagcagcgccggccagcgtttccagcccagttccagccggccggcggcgcggcgcgcgccgcggtccagccgctggtagcggctttcgccgcgcacgcgcagttcggccagcaggatcagcacgccggcggccatcagcacgctggccagcagcgacgcgccggcgctgtcgaagctggcgcggtattcggcgtagatttcggtggtgaaggtgtggaaatgcagcagcatgaaggcgccgaattccgacaagctcgacagcgccaccagcagcatgccgcccagcagcgccggcttcagctgcggcagcgtcacgcgccggaaacaggaccaggcggacaggcccagcgagcgcgcggtttcctccagcgccgggtccatattgcgcagcaccgccgacaccggcaggtagaccagcggcgtgtaggcggtggtcagcaccagccaggcgccccagaagccctgcagatccgggctgatggacacccaggcgaagctggtgatgaagggcggaatggccagcggggccacgcacagcaatgcccacagccggtggccgggcaagcgggtgcgctccaccagccaggcggaggcggtgccggccacggcgcagctgaaggtgctggccagcacgatcaaggcggtgttgccggccagccgggcgacgatggggcgcagcagcagttcggcggcgtcgccggagccgacgctggccgcctgccacagggtaaagcctagcggcagcaaggccagcagcgccaccagggcggcgctgacgatgaggccggcgggccgccggctgctgccgccagccaggcgcatggcgatgttcatcctgaaaacctcattggaaaagcctgatgcgccgcgaaagccccaagctgcgcggctttcgcggccggcgcgggcgttacagcaggcccgcctggcgcaatagcttggccgactggctgtcgtcgcccagcttctgcatgtccagcggcggcgggttcagctggttgaagggcttcagctgcggggccggcgccacgcttggcagcagcgggtattcgaaggtgatgttgctcttggcgatcagctgctgcgcgcgcgggctcaccaggtaggcgaggaacttctgcgccgcgtcggcgttgcgcgcggttttgaggatgccggcgccggagacgttgatcagcgcgccgacgtcggcgttgccgaagtggtacaactggctgtgcatgcccttgctgcccagctccacctgcaggcgggtccagtagtagttgttgatgatgccgacggccacgccgccgcggttcaccgccgccaccacgccttcgttgtcgtcgaaggtctgggcgttgtcgcgcaggcccttcagccaggccagcgtcgccggctcgcccttcagcgcgcgcaccgcgctgaccagcggcaggaagtcgccgtcggacggggcgatggccagcttgcccttccattgcggcttggccaggtccagcagcgaggccggcatctgggcgccggcggccagcttgttgttgaacaccagcacgttttcacgcgccatcacgcccacccattcgccctgcggcgagctgtagcgcgccgggatggcggagaaggtggcggccggcagcttggccagcatctgcttgccttccagcagcatcagctcgggcgagttggaggcgaagtagacgtcggccggcgaggccttgccttcggccagcaattgggcggacaactccgggccttcgccggagcggaccttgacgctgatgccgctcatcttttcgaagtcggcggtcaggagcttgatggtttgcggatgctgggcgttgtacagcactaggctggcggccgtggatagctggctggcggccagcagcgagccggcgagcagggcggagatcagtttgcgtttcatggcttggtggctcccttgtggacgccgccgggcggcgtccggttggatggttcagagctggaacagggcttcgccgatgtagccgcccgggcgcgcgccgggcgggcaggcgaaaacggcgctgccgacatgggtgatgtactgattcatcatatccatcgccgccagcttcttgttgatgcggatgaagccggtgcgcgggtcgcgctggtaggcgatgaagaacaggccggcgtcgtattcgacgccctggcgccagggcggccagcgctcggcgtagaagttggcgccgtcgttgtacgaatacgcgcggcgcaggatgcgggcgccgtcgttttcctgcggcgaagccacgcgcgaatgggcggtgtccggaatcagcgggttgccgtctttgtccgccgcggccaggttcatcggctcgaattcatgcttttggcccagcggcgcgccgctgtccttgtagcggcccaccacttcctgctggaagcccagctcggtcttgtcccagtgctccagcgcgatgcggatgcggcgcaccaccaggtagctgccgttcttcatccagccgccctcgtcgccgacccagatgaactggttcatcagcgccgggtccttggtggacgggttgttggtgccgtccttgaagcccatcaggttgcgcggggtgccgccgccgggcgcgccgctggcgaagccggtctgcacccagcgcacgctggcgatgccgtcggcgatggcggccaactggcgcaccgcgtggaaggccacttgcgggtcgtcggcgcaggcctggatggacaagtcgccgccgctcttttccggcaccagctggtcgccattgaacttgggcaggtccaccagcgcttccggcctgtgcttggccaggccgtagcggtcgacgccgttcttgctgaacaggccggggccgaagccgaaggtgagggtcaggcgggcggtggcgaggccgacggcttcgccggagtccagcggcgccttgtcgctctggcccgacagcgcgcgcgccggcaggccctggctcagccgccgcgcggcctcggtccaggccttgagcagggcgatcacctcttcgcgcttggcggtttgcaggtcgaaggcggcgaagtagctgttctgctgctgcggggtgaggatgccgccctggtggacgccgtcgaagggctcgcggccaggctgcgccgccgctttggtgtggccggcggctgcggccagcgccttgccgccgcccagccagcctgccagcgccagcgcgccgccgcctttgaggaagccgcgccgggacggctgtttcggcttgtcgcggtctgtcatttcgccaataccaggttgttgttgtcgtcggcgacgaaatagaagccgtcgccttccggcgtcatggcgatgccgaacaggtcgccgttgccgggcggggtttgcgccttgttggcgtctatccagcgcgcgcccagctgctcgccgttggccgggtcgatttccaccaccttgccgttggagccgttggtgaccagcaggtggccttgcggcgtggtggccagcgccagcggacgcagcagcaggccgtcgtgggtcagggtgcggccgatgccggcgctggtggtgcgggtggtggcgtcccagatctcgctgatgcggttgcccagcgcgtcggatacgtagagcttgtcgtccttgccgtaggcgaggccggtggggccgatcaggaacacgcccttgtcggcctgctcgccgaagccgctggccaccacggtgcggctgacgatcctgggcggctggccggcggggatgtccagctccagccgcagcacggtggcgaggttcaccaccggcggcgtgcccttggcgctgccgacgccgaagccggcgttgctgacgaacagggtcgccttgtcgccgttgtctatcaccgccatattgccccaggggttgttgatgtcggcgccggcccaggtgtcgaccagcttgccggacgaatccagcaccatcaggcagccggcgcccttggtatcggtggtgccgtcgttgctgggcgtgctgcccactatcacccagccgcttttcagcaccgtcatcgcggtggacaggccgacgccgcccgggcactgcggcagcgtgcgcgggatttgcgcgaacagggtcaggctcttgctgtccgggtggtagttgacgatggtgctgcccaggccctgcaggttggcggcgttgttgaagttgtccaccagcacgtcgccctgcttgagtttgccggcgctcaccggcgacaccgcgatcgcgtacgggttctggtcgccgttgtcgggcacggtgttggccaggatggtgtggcgcttgatgccggcgaggaaggcgccgtcggcatgggccgcgccggccagggccagcagggtggcggcggcggccaggccgcggcgcgagaagttccgcttcatctttactctctccattgcggccggatcggtggtccggcctgtctgcaggttctgactcagaaggtgatggtggtcttcaggcccaccacccagttgttgggaatgcgctgggtctgggtcgggtcgttgggcgacaccgcgccggcgccgacgttgcgcacgtactgcaggtcggcctgccattgccaccatggcgtcaattgataaatgtaggtggcttcgacctgggtttcatcgctgcgcaccggataggccaagttgccgttggcgatgccggtgtcggcgtcgttgccggcggcgtggttgcctaccttgacatagccgaccgccaggccgacggtgtcgttgtcgcggccggcgaacggcgcggtcagcgtgacgccggcgttggcggagaagctgaccaggttgcggtcgcccggcgcgcccatcagtcgggtgaacacgttcagcgtctgggtgctgtcttcggccggacgccacaccgtctggtcggctaccgcgtagatgctgtagttgccgctgtgcagctgcgggttggcgccggtgagggcgatgggctggccgttgacgtccatccgggtgtcggcggttttctggttcaggtaccagaagcccagcttgtaggtgccgggcaggccggcgatgccggtcgcgccgcgcggcgcttccaccgcgccgttggacggcaggttgcggccgtattgcatctcgccgatgaacagcgtgccgccgtggcggctgaaggtggtgccgtgcttgttcagctgctgcgggtcgttcgggttctggctgacgtcgcgggtggggtcgccggcgaaggcgccgcccagcagcgtgatgttgtcgcccagcttgccgcgcaggcgcacccccaggccggacagcgggtaggccgggccgccggccggcaggtcggccgacggcaccgccggccagccgaacatggtgccgatgaaagcgccgccgtactgggtgaccatgaattcctggtccaggctctgctggccgatcttcacgtccagccgctcgccgttcagctgctgctggaaccaggcctcccacagccgggtggcgcggtcggcctcgatgccgctggcgctctggatgctgccgacgtgatcggcggtgaaggccttgccgtggatgtccagcgcgctgacattgaagctgccgccgttccaccagccggcgcgctgggtatccaggcccagggtcagggtggccaggccctggtagtcgccgccgtacttgacgccgccgctgacgttgcgcaggtattcgctggcctcggtcaggcccagggtgacgccctggcggcccagcgccgagcgcaggccgcccatgtcgcccagcagggtggagcggttccaccagccggtccactggttgtcgggtttggctttgatcgcctggtcggcctcgggcaggtcggccggattggctgcggcgtcggtttcctcggcgtgggcggcctgcaggccgcagcccagcagcacggccagcgccagcgaggagatccggagcggcttggcggccgcgttcggcaggaaggggcgtttcacgttgtcgattctccattcttcggccgcctggcggcactgttctaattgattcttattactgttatatcccgtggcgcgatgattgccagcgccaagcggacgagcggcgtgctatttcgcaatgaattcgcataaaaagcgaaatcagcgcgccacagctggagccgcatggcgtttgtgcgctatgctgcttcgcagcatccggtggttttgccgggatcgccgcgcgttcctctcaataaacgacaatcattcttgtttggttgacgagattgctgcattttttgcagcaggcatgccggatgagaaagaatagactgtattttgtctgacaatttaaatcgggcagcgtaaaactttctatacgcccatgtcgcatcccggatagtggggcgcggccggcttaatttagaatcgatcgacagcataaaaaaacgcacgacagaacaaggaaggaaaccatcaatgagcaataccgtatcccgcgctgatttcgaccaggtcatggtgcccaactacggcccggctggcttcatcccggtcaagggcctgggttcccgcgtgtgggaccaggacggccgcgaattcgtcgacctggccggcggcatcgccgtcaactcgctgggccactgccacccggagctggtggcggcgctgaccgaacaggcgaacaagctgtggcacgtgtccaatgtgttcaccaacgagccggcgctgaagctggccagcttgctggtggaaaaaaccttcgccgagcgcgtgttcttctgcaactccggcggcgaggccaacgaggccgcgttcaagctggcgcgcaagtacgctcatgatcatttcggcgcggacaagaaccagatcctgtcctgcgtcaattccttccacggccgcacgctgttcaccgtcagcgtcggcggccagcccaagtacaccgaaggcttcggcccggtgccgggcggcatcgcccacttcgaattcaacaatatcgaatcgctgaaggcggccatctccgacaagacctgtgcggtggtgatcgaaccgatccagggcgagagcggcgtgctgccggccgatccggccttcctcaaggccgcgcgcgaattgtgcgaccagcacaacgcgctgctgatcttcgacgaagtgcaaagcggcatgggccgcaccggcgcgctgtacgcctaccagcaatacggcgtgacgcctgacatcctgtcctccgccaagggcataggcggcggcttcccgatcggcgcgatgctgaccaccgagaaggtggccaagagcttcgtcatcggcacccacggctcgacctacggcggcaacccgctggcttgcgcggtggcgcacaaggtggtgtccatcgtcagctcgcccgaagtgctggcaggcgtcgaggcgcgccaccagcgcctggtggccggcctggaagccatcaacgccaagcacaaggtgttcaagctggtgcgcggcaagggcttgttgatcggctgcgtgctgaccgacgaatacaacggccgcgcccgcgaattcctgaaggccgccgaaaagcagcagctgatgatcctggtggctggcctgagcgtgttgcgtctggcgccgtcgctggtgatcagcgacgccgacatcgacgaaggcctgaagcgcctggaggccgccgtcgccgaaatggcggccgccaagtaagcgccgcgccgcatggaccacttcatgcggcgccccccaagctaccccgataccatcgccacgaccccgttttgcgccgggtcgcggctgcggctgcgcccggttttcgggccggccattgcgcaacgagggaggatttcccatgtttaccgtgcgtcccatccggacttcggacctgccggcgatagagaggctggcccaggccagcggcatcggcgtcaccagcctgcccagcaaccgcgagaaactgttcgagcgcatccagcaatcgatccgcgctttcgagcatgaagccatcggcgatgccggcagcgaatactatatgttcgtgctggagcatggcggcgcggtggtgggcaccgcctccatctgcgcgtcggcgggcttcgacgagcccttctacagctaccgcagcgaaacggcggtgcatgcgtcgcgcgcgctcaaggtcaacaaccgcatccacgtgctcaacatctgccacgacctgaccggcaccgtgcagctttgcggcttctacgtggagggcgggctggatcaactggccgccgagctgatgtcgcgcgcccggctgctgttcatcgccggcgagcgcgagcgcttcggccgccgcatcatcgccgaaatgcagggcatccacgacgaggccggccagtcgccgttctggaacgccatcggccgccgcttcttcaatctggactttctgcaggtagagcaggccttcgtcagccacagcaagaccttcatcgccgagctgatgcccagctacccgatctatgtgccgctgctgccggacgaggcgcagcaggcgataggccagatccatcccgatttcgagcgggtgtgccggctgttgtgcaacgaaggcttcgaggccgacaactacctggacatcttcgacggcggcgcggtgctgaccgccgagctcgaccgcctgaaaacggtggagcaaagccgcagccatccggtggaaatccaggccagcctgccggcgcaggccagcctgcagctggtgagcaaccagcgcctgtcggctttcgccgccaccgccgcccgcgtcgccgtagtcgacggcgtggccttcatcaatcccgacgccgccagggcgctgggcgtggccagcggcgaccgggtgcgcgtcgccggtctgcaggcagagtgaggagaaccggccatgatgtttattcgtcccgttgaacacaaggacctggacggcttgatgaacctggcgcgcagcgccggcatcggcctgaccacgctgccggtgaacgaggagcggctgtcgcgccgcatcgcgcgctcggtgctgtctttttccggcgagctggacaaggcggaccactgctatgtgttcgtgctggaagattccgacaccggcgcggtggccggcatctgcgcgatcgaggccgcggtggggctgaaggagccctggtacaactaccgcgtcggcaccatcgtccacgcctcggaagagctgggcgtgtacagccgccacgagacgctgttcctgtctaacgaccataccggctattccgagctgtgcacgctgttcctgcacccggactaccgcgtcaagcgcaacggcggcctgttgtccaagtgccgcttcctgttcctggcgcagtttccgcagctgttcggcaagatggtggtggccgaaatgcgcggcgtgtccgacgaagccggcaactcgccgttctgggaggcgctgggccgccacttcttctccatcgatttcgccaaggccgactacctgaccggcgtcggccagaaggccttcgtcgccgagctgatgcccaagcacccggtgtatgtcgacttcctgccgccggaggcgcaggcggtgatcggccagacccacgagggcacccgcccggcggtggcgctgctggagtcggaaggcttccgctatgaaggctatgtcgacatcttcgacgccggccccaccatccaggcctatgtcagcgatatccgcgcggtgaaggaaagccagcggctgccggccaaggtgtgcgacccgctgccgcagggcgagcgcgaatggtacttggtatgcaacgacgcgctggcgggtttccgcagcgtgctggtggaagcggtgcgcccgcaaggcgaattctgcctgacgcctgagctggcgcgggcgctggatgtgcaggacggcggccatgtccgctgcgtgaccttgacgccgaaggaggcagtgcaatgagcagtctgttcatcgatggcaagtggctggccggcgacggcgtagccatggccaaaaccaatccggccgacaatgcgccattgtggagcggccgcgccgccagcggcgcccaggtggacgccgcggtgcaggctgcgcgcgccgctttcccggcctgggcgcgcgccggtctcgacgcgcgcgccaaagtggtgcgccgcttcggcgaattgctgaccgagcgcaaggccgagctggcccgcgtcatcgcccaggaaaccggcaagccgctgtgggaggcgacgactgaagtcgccaccatggtcggcaagatagacatctcgctgaaggcgctggccgagcgcaccggcgagcgcgccgcggcgatgggcgacgcccaggcggtgttgcgccacaagccgcacggcgtggtggcggtgttcggtccgtacaacttccccggccacctgcccaacggccacatcgtgccggcgctgttggccggcaacgcggtgatcttcaagccatcggaactgacgccgtggaccgccgagatcaccgtcaagctgtgggccgaggcgggcttgccggccggcgtgatcggcctggcgcaaggcgccaaggacaccggcgtggccttggccggccatgagggcttggacggcctgttcttcaccggcagctccgccaccggcgcgctgttgcacaagcagttctccggccgcccggacaagatactggcgctggagatgggcggcaacaacccgctgatcgtcggccccgtggccgatgtggacggcgcggtgcatcacgtgatccagtcggccttcgtctccgccggccagcgctgcacctgcgcgcgccgcctattggtgccgcaaggcgagtggggcgacgccttcgtcgcccgcctggtcgaggtggccggcaagctgcgcgttggcaagttcgatgccgagccggcgccgttcctgggcgcagtgatttccaatgccgccgccgacgcgctgctgaaggcgcaggacgcgctgctcgccgccggcggcaagccgttgctggcgatgcgccggctggaagcgggcgcggcgatgctgacgccgggcatcatcgacaccaccgccgtggtccgcccggacgaggaattcttcggcccgctgctgcaggtgatccgctacggcgatttcgaccaggccatcgccatcgccaacgacacccgcttcggcctggccggcggcgtgctgtccgacagccgcgagctgtacgaccgttactggctggaatcgcgcgccggggtggtcaactggaacaaacctttgaccggggcctccagcgccgcgccgttcggcggcatcggcgcgtccggcaaccatcgccccagcgcctactacgcggcggactactgcgcctacccggtggcgtccttggagtgcgacactctggcgctgccggcccagctgtcgccgggcatcgtgttgtaagcgcgccttctcccccaagcgctcttcctcgcgggagagggggcggcgccgacaggcgccgtctgatggcgggacatgagcaatatggcgaggcgatccggcggaccgtcctcgccattcagatggattgaggcaagggagcattctccaaatgaacgcctatgaagtgaatttcgacggcctggtcggcccgacccacaattacagcggcctgtccttcggcaatgtcgcgtccaccagcaacgtcagcgcggcatccaatcccaagctggcggccaagcagggcctgcaaaagatgaaggcgctgcacgacctgggcttcaagcagggcgtgctggcgccgcaggagcggccggacgtggcgtccttgcgcaagctgggcttcggcggcagcgacgccgaggtgatcgcccgcgccgccaaggaagcgcccgccatcctggcggcggcgacctcggcgtcgagcatgtggaccgccaacgccgccacggtcagcccgtcggccgacaccgccgacggccgcgtgcatttcacgccggccaatctgaacaacaagttccaccgctcgatcgagcatccgaccaccggccgcgtgctgcgggcgatgttcgccgacgaggcgcgcttcgccgtgcacgcggcgttgccggcgcagatgcacttcggcgacgaaggcgcggccaaccatacccgcttctgcgccggctatggccagccgggggtggagttcttcgtgttcggcgcggcggctttcgacatgcgctacccgaagccggccaagttcccggcgcggcagacgctggaggccagccaggcggtggccaggctgcatggcctggacgaggccggcgtggtgtacgcgcagcaagaccctgacaccatcgacgccggcgtgttccacaacgacgtgatctcggtcggcaacggcgaggtgctattccatcaccagcaggccttcctcaatcaggccgacgtgctggaggagctggcccgcaagctggccgcccgcggcggccgcttcgtgcccatcgaggtgccgcgcgccgaggtgacggtggaggaggcggtgaagagctatctgttcaacagccagctgctgtccaagccggacggcaagatgctgatcgtggtgccggaagagtgccgcaacatcgaacgggtatggcgttatctgcagaagctggcagccagcggcgggccgatcgatgaaatccgcgtgttcgatctgaagcagagcatgcagaacggcggcggcccggcctgcctgcggctgcgggtggcgttgaacgaggccgagctggcggcagtgaatcccaaggtgttgatgagcgacgccttgttcgccgagctgaacggctgggtggaccgccattatcgcgaccgcctggcgccggccgacctggccgacccgcagctgctgtccgaatgccgcggcgcgctggatgagctgacccgcattctgggcctgggcagcgtctatcccttccagctggcttgagtccgcattcatagccagcaggcttggcacaacggcccgccgcgcgaaaagcgcggcgggccgttcgcattgcgcgccccacggctgttaacaaattgcggccgcgccataccaaatgcggactatggtgagaattggcatggttgttgcatacgcttggctggtgtggggtgggcgtcacaactggcaacaatctgcgcagattaatttttctggcggcagcgccttggccgaatagatagcggctaatactgtagattgtatgcaagtgaacgaagctcatgtctgattgttcgcaaagctggcttcaggcgggcagggcatgttcgaatgtgaataaaaagaatgggaattatgaccgaaatgtaaaaacggcatggaaagggaaagagttttgtcaaatcatcagcctggaaaaattccacctggagaggtgttgataaagtccatattaatcaatgatatatattgaattaaatgctttttgcgcagctgtttttttggcgaatcttcgcaattgacagtcgattggatacatggtgataatcggttcgcctgtcggacagaagccaagaaaaaggcccgccgcgggtgctacaacaggcagcagtcaataagaggattcatcccgcaagctgccggtcgacaatcagaggagatctccaaacgtggacatttttctgcaacaaatcctgaacggactcgttctgggcagcatctacgcgctgatcgcgctgggttacaccatggtgtacggcatcatgggcctgatcaacttcgcccacggcgaagtggtgatgttcggcgccatggtcaccatcaccgtcatcaccaccctgatgggcatgggcgtcaaccttccgggtccggcgctggtgctgatcggcctgctggtggccatccccgcctgcatgctgctgggcttcgccatcgagcgcatcgcctaccggccgctgcgcggcaaacagcgcctggcgccgctgatcaccgccatcggcgtgtcgatcgtgctgcagcaggtcgccatcctgatctggggccgcaactacatccccttcccgcaaatcctcgaccatgacgtggtgaccatcttcggcgccagcatcaccaagctgcagatcgtcatcgtcgtgctgtgcctggccatcatggccggcctcttgctgatggtggaaaagaccaagctgggccgcgcgatgcgcgccaccagccagaacccggcggtggcgggcctgatgggcgtcaacgtcaacaccatcatctccaccaccttcgtcatcggctccggcctcggcgccatcgccggcgtgatggtggccaccaactatgagcaggcccactattacatgggcttcatgatcggcctgaaggcgttcaccgccgcggtgctgggcggcatcggcaacctgggcggcgcggtggccggcggcattctgctcggcatcatcgaaagcctgggcgcaggctacatcggcacgctgaccggcggcttcctcggctccaactaccaggacatcatcgccttcatggtgctgatcgcggtgctgatcttccgtccgtccggcctgctgggcgaaaaaatggccgatcgcgcctgatccggagagagaaacatgaatctgaatactctggacaccaacaagaagatgggcctgttcgccctcagcgccatcgcgctgctggtgctgcccttcgtggtgggcggcgcgctgggcaattcctgggtgcgcatcatcgacttcgcgctgctgtacgtgatgctggcgctgggactgaacatcgtggtgggcttcgccggcctgctggacttgggcttcatcgctttctacgcgatcggcgcctattcctacgcgctgctcagttcgccgcatttcgacatccactggctgttcttcctgaccatccctctgggcgcggcgctggcctcgctgggcggggtgttgctgggcacgccggtgctgaggctgaagggcgactacctggccatcgtgacgctgggtttcggcgagatcgtgcgcatcttcatgaacaacctgaacgcgccgatcaacatcaccaacggtccgcagggcgtcaacctgatcgatcccatccatgtcggcagcgtcagcctgggccagaccatcgagctgttcggcctcagctttcacagcgtgtacctgtattactacctgtttctggcgctgaccgtggcggtggtgatcatggtgtggcggctgcagcactcccgcatcggccgcgcctgggtggcgctgcgcgaggacgacatcgccgccgcggcgatgggcatcaacatccgcaacatcaagctgctggccttcggcctgggcgccttgtccggcggcgtggccggcggcctgttcgcctcgttccagggctttgtttcccctgagtcgttcagcctgctggagtccatcatgattctggcgatgatcgtgctgggcggcatgggccatatcccgggcgtgatcctgggcgcggtggtgctgaccatcgccccggaaatcctgcgcgacgtgatcggcccgctgcagatgaaaaccttcggccggatgctgatcgatccggaaaacgcccgcatgctgctgttcggccttgccatggttgtgatgatgctggtccgcccggaagggatgtggccgtccaagcgccgcaaggctgaattccagcacgccaaagaagaagcggctgcgcagaaaggttaatcatggctgaagttttgctgaaaatcgaaggcattcataagcgttttggtggcctgcacgcgttgagcgacgtcggcctgaccatcaacaagggcgaaatctacggtttgatcgggccgaacggcgccggcaagaccacgctgttcaacgtgctgaccggcctatacgtgccggacgagggcaagttcgagttcgacggccacaatctgttccagcagaagccgcacgtggtggtggccgccggcatcgcccgcaccttccagaacatccgcctgttcgccgaaatgacggcgctggaaaacgtgatggtgggccgccacatccgctccaaggccggcgccctgggcgcggtgctgcgcgaccccggcaccatggcggaagagcgcgccatcgaggccaaggcctgggagctgctggagtatgtcggcatcgccgacgtggccgaagagcgcgcccgcaacctgtcctacggccaccagcgccggctggagatcgcccgcgcgctggccactgagcccaagctgctggcgctggacgagccggccgccggcatgaacccgcgcgaaaccgaagagctgaaacagctgatgagcaagatccgcgacggcggcgtgaccgtgttgctgatcgagcacgacgtcaaactgatgatgggcctgtgcgaccgcatcgctgtgctggactacggcaagaagattgccgaaggcgtgccggaagaagtgcgccgaaacccgaaagtgattgaagcctacctgggagcggcccacgcatgagcattctggaagtcaaaaacctgcaagtggcctatggcggcattcaggcggtcaaggggatagattttcacatcgaccagggcgagctggtgacgctgatcggcgccaacggcgccggcaagaccaccacgctgaagacgctggtgggcatggtgaagaagtcgggcggcagcatcgtctacgacggcaaggacgtggcgtcgattccttcctacgacttcgtccgccacggtctggccatggtgccggaaggccgcggcgtgttcgccaagctgacggtggaagaaaacctgcagatgggcgcctactaccgcaacgacaaagaggcgatccagagcgaaatcgagcatgtctacgagctgttcccgcggctgaaggaacgccgactgcagctggccggcaccttgtccggcggcgagcagcagatggtggcgatggggcgcgcgatgctgtccaaacccaagctgctgctgctggacgagccgtcgatgggcctcgcgcccatcatcgtcgagaagatcttcgagatcatccagatggtggccaagcagggcgtgaccatgctgctggtggagcagaacgccaaactggcgctggaagtgtcgcagcgcggctacgtgatggaaagcggccgcatcaccatgagcggcgacgccaaggagctgctcaacgacgagcgcgtgcgcaacgcctatctgggcgaataaggcgattcgctcgccgatatcgcaaatcccccgccggcctgccggcgggggatttttgtttggctgcccgccagggaatcctggcaatgcaaacccgcggctgggcgggcggcgggcgctcagattttggcctctttcagcatcttgtccagcgtgccgtcctgccgcatcgtctccaggccgcgattgaagtcctggatgcgtttttccgcctgcggcagccgtttggagatgcccaggtgcatcgggtagacgacgacgggcggcggcagccattccagcttgggcgcgagggcgaccaggctgccgcccagcaggtaattggcgacgccgcggtctatcaaggcgaggtcgatgtgatgggcggccagcttggacagattgctggcgtcgctcaaggtttcgtcggtttgcaggcgggcggcgtcgaaggcctcggagttggcgtagccgcgcacgatccctatggtgtagggcttgaggtcggccagcgcgcggtagcggatggggtcgccgctgcgcttgaaaaagccgatgtggttgtcgaggaaggcttgggaaaacaggaagcgctgcaggcgttcgggcgtggtccacaggccgacgatgccgtccagatggccgtcgcgagcttcgttgacggcgcgcgcccacggcatgtagaccgctttggccgaatagccggcgcggcgcagggcttcgcggacgatggcgacggcgacgccgccgttcgccatctgcgacgacatatagggcgggtattcggaagccgccagcgtcagcgtttcgccggcgcaagccgcgccggcgcggagggacagggaaaccacaagcatgagcgcgtatttccagctggccatcgtctctcccatgtttgccgccatgcggcggcggcgtctgccctattcgagtataacgacaaagcccggatgcgcatgctcggccgctaggcctgattggctcggctccgattgagtaaaggcggcgatttcgctaaattcagggtaagccccttgctggcgcagactgccatgagccgttatttcccgctgtccgccgcactgttcgtcctgctgttgtcgcagtccgccgcggcgcagctgccggcgctgcatatcctgaccgaggacgatccgccgctcaccttcagccagaacggccagccggcggggctggtggtggaggtggtgcgggagatccagcgccgggtcggcagccacgacccgatcaccgtgatgccctgggcgcgcggctatctgctggcgcaaacccaggctaacacagctttgttcaacaccaatcggatcgccgagcgcgagcatctgttcaaatgggtgggaccggtcaccgccacgctgggcagcttcttcgtccgccgcgacagcaagctcaagctggtgtcgctggacgatgcgaggaagctggaccagattctggtggtgcgcgactggtatctgcaactgacgctgtcggcgcagggtttttccaatctcagcgccatcgccacgcccaaccagatggtgtcgatgctgatgcgggggcgcgccgacgtcatcgccagcgagaacaccacgctgccgacacaattggcgcagctggggtatcagccggcggatgtgcgcaaggcctacaccttcatccgcacttggggctatatcgccttttcgccgcaaacttccgacgcggtggtggcggcgtggcagcgggcgctggacgacatgaagcgggatggcagcttcgccgccatctaccgccgctggctgcctggcgagccattgccggcggcggccgcagaaaaatgaaatggacggcggggccgccgcgtcttcttgcaagggggaaaccatgtatagcgtcaccgttttggcgcatcggctgcttggggcgctgctgctgccgccgattctcaatctgctgcccatcattgccggcggcatgctgatacggcgttgtccgcatgccggccggctgctgctggcgtccggcgtggcgctgacctattttctttcgataccgcagaccgccatctggctggcgcatggactggagcgctatccggtgatcgacgccgcgcaactggcggacgtggacgccatcgtggtgctgggcggcggcaagcgtccggcggaagagttcggcggcaacgctccgggcggcgacacgctgacgcggctgcgttacggcgcttacctcgcccgcgccagcggcaagccgattttggtgaccggcggcgcgccgagcggcggcgaggccgaaggcgcggtgatggcgcgggcgctgcgcgaggattacggcctcaagccgcgctgggtggagctgcgctccaacaccacgctggaaaacgcgcagctgtcggcaccgatgctgcaggccgccggggtgaagcgcatcgcgctggtcagccagggctggcacctggcgcgggcggtgccgtttttccggcgccagggcctgcaagtgctgccggcgcccaccgggctgattcgctacgacggcgccgccgctttcctctacattcccagcggcaacgcgatggcggagtgccgcaccttgttgagcgaacgcctgggcctgctgttttaccgcatccggccgacgggctgagcctggcgccgctggcaggccagcgccagcagggcggccagcgtcagcgtcatccccaactgctgcgccaatccggccagcgccagtcccaggctcagcaacaggtaataggacaggccgaacagcgcgccggcggcgccggcctgatcgcggtaatggcgcagcgcccggctcagcacattgggaatggcgatgctgaaggctatcaccgcgccggcggccggcaacaagatccaggccgacgcctgcagcagccaggccgccaggccggacagcaaggccagccggcaggcggcccgcaccagctgttctgactggaggccacgtcccaacaatctgcgattcagcaagctgcccgccaatgacgccgcggccagcgccgcgcctgagccgccgaactgctccgggctccagcccagccgctgaaacaggaagggcgccaggctgtagtagctgaacagcatggtgttgaacagcgccaccagcatcgcgtcgcgccatagttcggcgtcgcgcagcatctggccggccagccgggccatatcggggcgcgccgtgcctatcgggcgggtttccggcagctgcagggcagtcagcgccagcagcgcgacggcaagcagcagcaaggcggcgaacacgccgtggtggccgaagcggccggccagccagccgccgctgagcaggcccagcactgggctcaaggccagcgtcgcgcccagcagcgagaacacgcgggccagccgggtggaatcgtagctgtcgcgcagcatggtctgcaccactaccgagccggccgccgcgcccagcgcggaaatcatccgcgccagcaacagcatgttgaaatcgttcgcggccagcgccagcgcggagccggcgccatagcaggccaaacccagcagcatcgccgggcggcggcctatgcggtcgctcagccagccccacagcgccacgccggcggcgaaggccaggaagtagaccgacagcgtttgcgatgcctgcgcctggctgacgccgaaggcgaaggcgatgtcggtcagcgccgggctgtaaatggtttccaccagctgcgggaatgtgatcagcgccgtcagcagccacagcgccggacgggtcgtcgttttcatggttttttcctttctttcttgacgattggcagtctagagaaaggcggtttgtctgattacaatgataaggactttatttatttaaaatcggacatatggcttggattcccgctgatcaggcattcgacgccgacggcttcgacgcgccgatgataggcatcgccgccgacatgggcgtgcatgactccggccgccactgccaccgccgccatcagctgctgttcgccgccgccggctgcatcaccatcgagttggcggatacgctgtgcctgctgccgcccagccgcgccgcctggattccggccggcaccgcgcaccgggtgcggatgcgcggcgtggtcgcttaccgttcgctgtatttcgccgtcgacttgcctttccccgcgccgcctttgcaggtagtggaggtcaatccgctgctgcgcgaggtgatagagcggatggcttggtggccatgggatttgcccgcggagcggcaacgcagcctgttggcggtgttcggcgaggagttgcaggcggcgcggggagaaaactggcggctgccgtttccggcggatgcccggctggcctcatggctggatggcgtgcgcggcggggcgcagccgccgcggctgaatcaactggcggacgcggtgggggccagcgagcgcaccatcagccgcatcttcatccgcgacaccggcatgagctaccaggcctggcgccagcagtggcgcctgctgcgggcgatggaaatgctggccgacgggatggggacgagcgagacggcgcagcggctggcgttcgccagcgacagcgccttcatcgcctttttccgccagcacaccggcgcgacgccggcgcggcgcgctcagtccagcgtgtccaggtagtcgcggacgggccagcgcgcgtattgccgccaaggcggaacggtgccggcggccagagcctgcgggctgactcgtatggtttcgcgctggcggccgtcggccgagcgcacttccacttccagcggcagctgccagcgctggctccagcgcagcgtcttgctgccctgggcgctggttttgctgtagcgcgcgacgtctttttcctcctgccgcagcgagaagccgcgcagctggctgatgtccaccaactggctggcctgcgcccaggagccgttgaagccgacatcgctccattcgcgcggcgcggtctggatcctctcttttttgccggcgtggatgaactccagttgcggccgcccctgggcgtccagccagacatggcgtggcgcggcggcgaagtccaggtgctggtggccgtcgtcgtcgtggcggtgcggcgcgccggcgttcaggcgctcgcgccagacatgtccattctggcgcaccagcttttcgcggtagcggatggttttctcgacgccgtcggcgcccaggctgacggtttcgtaatgcaccacggcctgcaggtcgggggccgcggcgcgggcgggagctgccagcgccagcagcagggagagcaacagcattttcatcggcattccattcgataaaggaaaagccgcgcggcaggagccgcgcggcgatggcgcggcggtttacaggcccagcgcggttttcaccaggccgaacaccctggtgttgtccatcacgcccttgaagcccttgctgccggcgccgccggacatcagcatcacgtcgccgccgccatgggtttcgctggacaggcggatgccggtctcctgctggtagtcgtcggcggtggcggcggccgaatccaccgacacccgggtcggtttgcggttggggccgttgccgaacaccagagtggtgtagacggcgccgtcggcgtccttcgccggctggccgtcgacatagctgcgcgagatgtcgtgaatggggttgccgcgcttggaatagccgttgatggtcatggtgtggtcgtggtcggcggtgacgacgatcagcgtgttgctcaggttggccttggccagcgcggtcttgatcgcgtcgtcgaaggcgatggcgtcggtcagcgcgcgcttggcgttggtgccgtgcaaggcgtggtcgatgcggccgccttccaccatcagcacgtagccgttgctgtttttggacagcacgtctatcgccgccgcggtcatctgcgccagactgggctggtccaccttgttcttgacgcggtccagctcgtattccaggtggtccttgccgaagatgcccactacgcggctggcggacttggcgtcgaaggcggccaggtcgctgccggtctgcagcaccgggtagccggtggcggcgaattcctgcagcaggttgcggccgtcggcgcgcttgccgccgctggccttgggcagcaggaacttgccgccgccgcccatcagcacatccaggccgccgcccagcctggcgttgtagccggcgccgccgggcaccgcctgggcgatgatgtcggattcggcgtcgcggtggcagacgtgggcgtaggtggcggccggggtggcgtgggtgacgcgggtggtggtgaccgcgcctatggccttgcccttggccttggccagctccagcagcgtggcggccggcgcgccgttgttcgcgccgcagttgccggtgccgtcgctgttgggttcgatggcgcgggtgtcggacgacatcgagatcacctcgttgttcatcttcacgccggtcatataggccgacatcgacggcgcgctgtcggtggtctgcgcgtcattggagaaggtcttgatgcgagcggtgcggtcaagcttctccatattgagtttgccgccctcgccgtactggtagatgcgggctgcggtgacggtggccgggcccatgccgtcgccgagaaagaagatcacgttcttggcttcgccggcggcgcgggcgggggcggaggacagcgccgccagcgcagcggcggccagcagggttttcatcacggtttgcatattgtttttctccagagcgtttacaggccggcggccttcttgaccaggccgaacacttcgatgttttccaggaagccgtggacgctgtcagcgccctggccgatggcggcgatgtagacgtcggtgccgccatgggtttcgccgccggccggcatccgtatcgccgcttcctggtggtagtcgttggcggaagccgcgtcgtcggtcagcgcggtggccgcgctgcggtcgccggcgacgcggttttcgccgttgccgaagccgatgatggagtagggcatgccgtcggcgtcgaccaggttcttgccgctgacgtaatccttggccaggcccagcacgccggggttgcccggcgcggtcttgccggtgcgcttggcgtagccgttcagcaccagggtgtggtcatggtcggcggtgacgacgatcagcgtgtttttcaggccggggtctttctgctgcatcgcgttgatcgcggcctggatcgcctggtcgaaggccacggtgtcctgcagcgccttcttggcggtggtttcgtgcagggcgtggtcgatgcggccgccttccaccatcaggaacatgccctgcttgtcgctgcggccggccagcatggcgatggccttgctggtcatctcggccaggctgggctccttggcggcgtcgcggtccaggtcgtagctcatgtggctggcggtgaacaggccgacggcgcggcgggtccggaccggatcgatggcgtcgaagccggccttgtcggcggcgtagccgtagccgcgggttttcagctccgccaccaggtcgcggccgtcggcgcgcttgccgccggcggccttgggcaggaagaactggcggccgccgccgaacaccacgtccacgccgtctttcagcgcggcgttgtacagcgcgccgccgggcaccagctgggcggcgatgtcggcttcggcgtcgcggtggcagacgtgtgaataagtggcggccggggtggcgtgggtgacgcgggtggtggtgaccacgccggtggcgcggttgccggccttggccagctccaagagcgtggacaccgctttgccgttgccggcgccgcagttggatgtcaggtcggctttgggtgatttggccacggtgtcggtggacatcgagatgacttcgttgttcatcttgacgccggtcatgtaggccgacatcgacggcgcgctgtcggtgacctgggcgtcgttggagaaggtcttgacgaagccggattccggcagcgtgtccattgtcagctggccgtcttcgccgacggagtagatgcgggcggcggtggtggtggcgatgcccatgccgtcgccgaggaagaaaatgacgttcttggcgctggccgccggcggacggctttccgcgttgtcctgcggccggttggcggcgctgccgccgccgctgttgcaggcggccaggctgatggccatgagaaatggaaggctgagactgaaagtgcgcatttgaataaccttttttattaaaaaatgcgcacaaatattattttttgctggtttctgcccaaataagctgaggttaagctttgaataagaaaatgttaaatgtcatgcggcgggcgcgtcagcatttccacaggtgggcgaggaaggacactctcaccttggcgtcgccggcggggcagggcgcgaggactttcagccccggcttgttggtgtcgcgcagcagcggttcgccgtagggcgggccgtcggcgcggcggatggcggcgacgatgggcgcgctgggcttggcgccggccgagatcaccacgcagatttcctcgctggcgatgcgcacgaagctgccgggcgggtatatgcccagctcgcggatcagcagcgtggtgaaggactggtcgaactcgctgtccttgcgctggaagatctgccccagcgcggtggccggcagcagcgcggagcggtagcggcgcggcagcagcttggcgcaggtgatgtcggccaggcgcagcatgtgcgccggcggcaggatctgttcgcgggacaggccgtgggggtagccgttgccgtgccaggattcgtggtgggtttgcaccagcgtgtgccacagctggtcgtcgacgccggcttcgcgcaggatggccgagctcatcagcgggtggtcgctgatcgcctgcctctgttcggcgctgaggctgcccggctggccgaacagctcgttctgcagctcgatctgggagatgttcatcgtcagcgccgcgcagatcagcgtttcgcggtggcgcggcggcagggcgatgctgcgggacaggatggccagcagcgccgcggtgtgcagcgaatgggcgacgctgtattcggcgaacggcaccaggaagatggaggcgatcagcgcgtccgggtgggtttcggccagccggatcagcgtcagcgcgatctccatcgccctggcctcgaaacccggggtggccagcgcgtaatacagcatgctgcgcacgcgctgctgcaagaaggcgatgtcctcgaacagcgaatgtttcctgctgtcgttcagaatgggcttgtccaccggcctggcctcggacttgccttcggcgaagcccatattgaccagtttttgcttcaattccggcgtcagcacgtaatggccgcgcttgagcagcaaaaagccgtttttggaatagacgtccatcgacaattccttgccgatgtcgaccatggacgagtagaccctggttggtttttttgtggaatccaaaggcatgatgggcccgcttgcgacgtcaatgtttacaggatgataatctattgtcatcgcaagctggtagttttcacacctagcgcggcaggtctgcccatgctttcagcaagcgcttcaccgaaaccggatagggggtcttcagttcctgggcgaacaggccgacccgcagctcttctatcatccagcgaaattccagcagcgccggcgccgcttctccctgctcgctctgctccgccacccgctgttgccatttctgccataggtcgcggatttccgccgcgcgctggccgtcgcgctgcgggttggccggctgcttgtccatgcgcaggctcatcgccttcatgtagcgcggcagctgcggcagctggctccacggcgtggcggcgagaaagcccttgtagaccaggctgtccagctgcggcttcaggtcgtagcccagcttgtgcttctgcattttgttgcccagcggcgtgtattcggcggcgatttgctgcaggtattgcgaaaccgcctggatcaccgccggcaggcgggtgcgggcgcggttcttttggtcgttgaaggctttctcattgcgcggcagcgcgtcctcgccgatgaaggcgcggtcgcagatgcaggcgatggcgtcggccatcagctcgtcgacattggccaccgcgcgcagctgcaggccgatctgggtgatgccgggcaggcccttggacaactgcttcatctgttccttcaactgcagctgcagcaggcgcaccacgccctggcggtggtggcgctcggcggccagctgggtgtcgaacaggcggatcgccaccttgtcgtcctccagcgtcagcgccgggtagccggtgagctgctggcggccgcgggcgaactgtatgctttccggcagttcgccgaagtcccaggtcttgacgtcgtcgcgctcgaagtcggcgctggtgtcgcggaaggtcagctgcgccgcctggccgaactgcttctgcagcgccgccaggtcgcggcccaggccgatttcctgcttgccgtcgtctatcacccggaagttgaacagcatgtgttccggcagctcttgcgcgttgaattcgtcgatgtccaccttgacgccgcctgtctcgcgcaggatgaagcgcgccagctgcggcgcgatgggttgctgcaagtccggattgctcagcaggaagcgggtgacgaagtccggcaccggcacgcagcagcggcggatctgcttgggcaggcccttgatcaattgctgcagcttgtcgcggatcatgcccggcaccagccattcgaacgccgcaggcgtcaggcggttcaggatggccagcggcacgtcgatggtgacgccgtccagcggatgcttgggttcgaagcggtagcgcagcttcagtttgccgtcgtccagctccagccattccgggaactggttttcggtcacgtgctgggcggcgtggcgcatcagctcgtcgcgggtcaggtgcaagagcttgggctcggccttctcggcttccttgcgccaggcttcgaagctggcggcgtccaccacttcggctgggatgcgctcgctgtagaacgcgtacagcgcctcctcgtccaccagcacgtcctggcggcgcgccttgtgctcgagttgctccacttcgcggatcagctgctggttgcgctggaagaatggcgcgttgctgacgtagtccatattcaccagcgcgccgcggatgaacagttcgcgcgcttcttccggcgcgatgcggccgtagctgacggcgcggcgcggaatcagcgtcaggccgtacagcgtcacgcgctcgctggccaccacttcgccgcggctcttttcccagtgcggctcgaagtagtggtatttgaccaggtgcggcgccagcttctccacccattccggctcgatcttggccacgcagcgggcgtagaggcgggtggtttccaccagttcggccgccaccagccatttcggcttggctttcttcaggccggagccagggaagacgtggaaggcgacgccgcgcgcgccctggtagtcgtcgccttcctggtttttcatgccgatgttgccgatcaggccggtcaccagcgccttgtgcaggttttcataggcgacggcgtccagctgctggcgctttttcagcgtcatctgcgcgtccggctgctcggcgtcggcgtgggcttcgtcgcgcttgatcaggcccagctcgctggcgatctcggccagctgcgcgtgcagctcgcgccattcgcgcagccgcaggtaggacaggaagtggtcgtggcaggtgttgaccagcaggcggttggacttcttgtgcttgagcgcgtcggagaagaagtcccacaggtgcaggaaagacaggaaatcggacttctcgtcgttgaagcgggcctgggccttctccgccgcgtcgcgcgcttcgaacggccgctcgcgcgggtcttggatcgacagcgccgcggcgatgatcagcacctcgcgcatgcagtggaagtcgcggccggccaatagcaggcggcccactttcgggtccaccggaatgcgcgacaactccttgccgaccggcgtcagctcgcccttgtcgtccactgcgcccagctcggtcagcacctggtagccgtcggcgatcaggcggctggacggcgcttccaggaaggggaaggcatccaccttgcccaggcgcagcgcggccatgcgcaggatcaccgccgccaggttggagcggacgatttccgggtcggtgaacggcgagcgggcgttgaagtcgtcctcggcgtacaggcgcacgcagatgccggcggccacccggccgcagcggccggagcgctggcgcgcggcggcctgcgaaatcttttccacttgcaactgctccaccttggcgcgcgggctgtagcggttgagccgggcgaggccggtgtcgatcacgtacttgatgccgggcaccgtcagcgaggtttccgccacgttggtggccagcacgatgcggcggccgccggacggcttgaagatcttctgctggtcttcgttggacagccgcgcgaacaagggcaggatctcgtagccgcggatgccggacttgcgtagcttttccgctgtctcgcggatttcgcgttcgccgggcaggaagaccagcatgtcgccggggccttggcgcgacagctcgtccaccgcgtcgacgatggcgtcctccatctccatctcgcgctcgtcttcatcgcgctgcttcagcggccggtagcgcacttccaccgggaaagtgcggccggaaacctcgatcaccggcgcgccgtcgaaatggcgggcgaagcggtcggcgtcgatggtggccgaggtgatgatgactttcaggtccggccggcgcggcagcagctgcttcagatagcccagcaggaagtcgatgttcaggctgcgctcgtgcgcctcgtcgatgatgatggtgtcgtacgcttccaggtggcggtcggtctgtgtctccgccagcatgatgccgtcggtcatcaacttgatcaccgacttttccgacagtttgtcggtgaaacggatcttgaagccgacgtgctcgcccagttgcgagcccagttcctgcgcgatgcgcgtcgccaccgagcgcgcggccagccggcgcggctgggtgtggccgatcaggccgaacacgccgcggcccaattccaggcagatcttgggaatctgcgtggttttgccggagccggtttcgccgcagatgatcaccacctggttcttgtctatcgcgctcttgatgtcggcgagcttctggttgaccggcagcgcgtcgtcgaactccggcttgggcaggtgcgcgcggcgggcgtcggcgcggccgcgcgagcgctccacctggttggcgatgtccgccagcagcttgtcggcggactggtttttcttcagccggtcggcggcgtcggccagcttgcggcgcaggatgtggcggtcgcggatcaggcagcaggacagggcggatttcaggtcggcgaggctggcggcaggtgtcatcggctaaagaacggagaattgcggaaagcgcagattatagcagagcgggcggcggcgagccgcccgcgcttggcatcaggcctcggcttcctcctcgcggatttcccagcgtgggaacgggtcctccaacgtttgccaggtctccatgccgccggccagttcggcatcgttcagcaggcaggcgtcgaagccggccttcagcgcctgcttgtccatatccatgccgatcaacaccagctcctgctggcggtcgccgaacggctcttgccagcgcgcgcggatcagcgccaggctgtcttcgtcctggggccattccgcgcggtccagcgccgcccaccacagcccggcgcaggaatggcgggccaccgatccggcttgcgaccacaaggcggcgaactgcggccggctggccagccagaaatagcccttggagcgcaccacgcccggccattcctgccgcatccattgccacagccgctgcggatggaagggacggcgcgcgcggtagacgaagctgcttatgccgtaggcctcggtttccggcacatgctcgccgcgcagttcggccagccagcccggcgcttcggccgcggcgtcgaagtcgaagcggccggtatcgagcactttgtccagcggcacgcagccgaactcgctgcgcacgatgtcggcgcgcggattcagcgagcgcaggatgccctccagctccaccagcgcttcggcgctgatcagatcggtcttgttcagcacgatgacgtcgcagaactccacttgttcgatcagcagatccaccacggtgcgctcgtcctcctcgcccaggctggcctggcgatcggtgaggctgtcgcgcgaggcgtagtcgcgcaggaaattgcaggcatccaccaccgtcaccatggtgtccagccgcgccagatcagccaggctgcggccatcgtcgtcgcggaaagtgaaggtttcggccaccggcagcggctcggagatgccggtggattcgatcagcaggtagtcgaagcggccttccgccgccaggcggcggatttccagcagcaaatcctcgcgcaacgtacagcagatgcagccattgctcatctccaccagcttttcctcggcgcgcgacaactgggcgccgccttcgcgcaccaggcgggcgtcgatgttgacttcggacatgtcgttgacgatcaccgccacccgcttgccttcgcggttggccaggatgtggttcagcagcgtggtcttgccggcgcctagaaagccggacagcaccgttaccggcagcttgttcatgtgtgctccttgaaatgagggaaagagggggctaccacaccgcgtccagcgccagcagcacgcgggcttctccgggatgcggggcgggcgagcggtggatgacgccgcccttggattccggccattccgcgcccttgagcagcagcacggcgaacggcggcgcgctgccgatggcggcggcgtcgaggatcaggccggattccgcatcgggcaggccctgcgcggccgaacccagccgagagcggtttgccgcgggggaaggcagccattcggtgcccggcccctggtagcagcacagcaggcgcaggccgacgcggtccacgtggaagcgcgggcacatcgggcggctcagcacctccagccgggcgcccacttgcggacagccggtcagcgtggcgtacagctcgcacagccagtcgatgtcggcttgcagcgcgtcgcggccgggcaggtcggccagcggcaagtcggcgctttccccaggcgtcactatccgccgccagcccaggcccagtaggccgttttgctccgcgcggcgcagatagccggcgatggcggcgttgggcgggcggcggtacaggcacagctcggcgtcggcgtcgaagatggccgcaaggctggccaagttatcggaaaggtggatggtttcggcggtggcgtcggcggtcatggcgaggaatgatgcgaatgatttgcagaatgttatagcattacataaaataacgggcaagttataacataacaaaaagcaccggcgccaaccgcccccttaatcatggagattgcaaagatgaaacgattcccccgcctcgcgcttgttgccgcgctcgtttgctcgccgttgctggctcatgccgcggtcaatgtcgtcgccggcgaaaacttctacggcgatgtggcgcagcagatcggcggcagccatgtccgcgtcaccagcatcctgagcaatccggaccaggacccgcacctgttcgaggccagcgcatccacagccaaggcgctgagcgatgcccggctggtggtgtacaacggcatagactacgacccgtggatggacaagctgctgtccgccgccaaggctccgcagcgcaagaccgtggtggccggcgagctgctgaagcgcaagactggcgataacccgcatctgtggtacgacccggccaccatgccggcagtggccaaggcgatcgccagcgggctggaaagcgccgatccggcgcacaaggccgattacgatcacaatctgcagcatttcctggcctcgctgcagccgctgaacgccaaagtgcaagccttgcgcggcaaatacgccggcaagccggtgaccgccaccgagccggtgttcggctatatggcggaggcgctgggcctgaaaatgcgcaatgaaaaattccagctggcggtgatgaacaacaccgagccggcggccagcgatatcgccgcctttgaaaacgatctgaaaacccatgcggtgaacgtgctgttctacaacagccaggcatccgaccagtccgccaagcgggtgcagaaagtggcgcgcgccgccaaggtgccggtggtgggcgtgacggagaccgcgccggccggcaagcattaccaggagtggatgctgtcgcagctgaacgcgctggacaaggcgctgggcgggtccggcaagtgagcgcggtgtcgctggccggcgtcagcgtcggctatggccagcgccaggtgctggccgatgtcagcctggagatcgggcaggggctgttcatcggcgtgctcggccccaacggggccggcaaaaccacgctgatgcggaccatgctcggcctgcaggcggtggaccgcggcagcgtgcgggtgctgggccagccggcccggcgcggcaatccggctgtgggctacatcccgcagctgcgcagccacgccgcccatctgcggctgtgcggctgggacttcgtcgccagcgcctgccgcggccaccgctggggtttgccgctgctggatgccgcggcgcggcgcgaggtggggtgggcgctggacaccgtgggcgccggctcgttggcgcggcgtccgctctccgagctgtctggcggcgagcgccagcggctgttgctggcgcaggcgctgctggggcggccgcggctgttgttgctggacgagccgttgatcagcctggacccgcaccaccagcgcggggtggtggagctggtgtcgcgcatccagcgcgatttcggcatcaccgtgctgttcagcgcgcatgagcttaacccgctgctgccggccatcgaccaggtcttgtacctgggccgcggccaggcggcgctgggcacggtggacgaggtgatcacccggccggtgttgtcgcggctgtacggctcgccgatagacgtggtgagaatgagggaccgcatcttcgtgatgtcgggggaggtggaagtggagcgggaggcgcactgtcacgatgtttgaatacgatttcatgatcaacgccttcatcgccggcggcctggtggcgctggtggccggggtgaccggctatttcctggtgctgcgcggccaaaccttcgccggccacgcgctgtcgcacgtcggtttcgccggcgccaccggcgcggcgctgctggggctgccgccgctatggggcatgacgctggtcacgctgtgcgggggcgtggcgatgggcgcattgggcgagaggctgcagggcagcgacatcgccattggcgccatcctgtcattggcgctgggcctgggcatgctgttcctgcattttttcaccgcctatgccacgcaagccacggcgctgctgttcggcaacgtgctgggcgtggacaccgccacgctgtggacgctggccggtctgggcctgctgtgcctggcggcgctggctttcatctcgcggccgctggtgttctgcagcctgcagccggagctggccgaggccaagggcgtgtcgctgcgccggctgtccatgctgtttctcgctatcgtggcgctggccaccgccggctgcatccagatcgtcggcgtgctgctggtgttcacgctgatggtggggccggcagccaccgcgcagaagctgacggcgcggctgggcgtcggcgtgggcctggcggcgctgctggcgctgggggaggcctggggcggcatcgcgctggcttactacaccgactggccgtccagcttctggatcaccaccctcagcggcgctgcctatctggcagcgggcggcgcgcgaggcctgcgcgtgatgcgcggatagcaccgccggggcgctcgccccggcgtttgccatcagaacgcgtaagacaggcccaccccggcgctcagccggaagcgggtgccgcccaggtcgtggtccagcttctgttgtgccgccgccaggtcctgggcgctgacgccggccgccggactcagcgtagctttgccgccaaactgaagctgcgcgcccaggtcggaggtgatgcgccaggcggatgcgcccggcacggcgaaatcccagccgatacccagataagacccgagtggctggtattccatcttgccggtcagcggcccgacggcggacgcggcataacggttgccgcccagcgtgtagttgcccgcgccattggccgcgaagttcagatcctccctgggtttgccggacaaggtcaggccgccgctcaacctgaagccgctgtcgctgagcgggcgccaatccaggctggccgccagcgcgggattgggtttggacttcaactgatagggcgtgccgtccagcgccttgtcgtgcttgtagcggaaggtgtcggcgatgcctaggcgcagcgccaggccgttgtccagggcgcggccgacgccgagctccacgccggtgcctagcttggcgtagccgaaggtgtcgtcggcatgcgcggctgccaggtacagcatggccagcgcgccgcaggccgtcatcgcgaatttagctttcatggcaatcctcatcgttgattgaaggctcaggcgagccgggtgtgcgcattgtcgcggcaggccatgctgtccgcatgtgccgaaagatagagacggcgcgcatgactaacggcactcccggcgcgatgcggcgagcggcagacttgttgccaatacaagcgggagagcggaatgctggaaggattgaggtgggcggcgtggccgttggcgcatggttgggccaggccgggattttccatgaagagcgcaggctgcatgacatatggcttgtgttacgctggcgcatattgcgcggcatgggccgcgcttttcatattgacgcgggaaaaagccttctccatgcgaccttatctccatgccatcggctccggttccgcctggttccggcgcgcgctgctgctggcttgcgcgctgatgctggcgtctggcggcgttgacttatggcccctgccggaagcggcgctgcgcgagcaggccgctgcctggttgtggcctgcctggctggcgcatggcttgcgcggttggctgagcttgcgtgacgcggctttgctggtgttcgccgcgctgatgctgctgttcatgattgcgctgcggcgcggcttgtcgagcgaggcgccgccacggcgatggtggccatggctggcggggcagatgatcatcgcagccgtgctggaaccatggaccgagccgggacttgggtatctggtggcggccgaactggcctttctgttgccctggcgcggcgcggcggccggggcgctgttgcaggcggccttgatcgatgcggcgctgttgccttatctggcgcgcgtgggaaacggccatccggcctgcaatatcgccggtgcgctgccgccgccgttctggacggtggccgcgctggactggctgcaaggactggttttccaggctttcgccttctgtgtgggctatggctgggcggaagcgttgcgggggcggcatcggcaggcgcaggccaatgcggagctgcaggcgacgcaattgctgctgaccgaggcggtgcgcgaagccgagcgcgcgcgcatcgccgagggagtggcgcggctggcggcggatcaactggcggccttgcagctgcagctgagattggctgaggctaagttgggcgctgaggctgacacgcagatcgccgcggcgcgcgagggcgcgagccggctggcggaggagctgcgcggcgtcgcgcgcggcgatgccctggcatccttggacttgcgcgaggcgctgaataccttgtgccgcggcatcccgatgccgctggtcagattggatatggaggatgcgttgacgttgagcgagcccacgctggcgcatgcgatatttcgcacggtgcaggaggccttgagcaatgccttgcggcattccggcgccgccggcgcggtggtgaggctggagcgatcgggcgccggcgtggcggtgaccgtcagcgataacggcaaggggctggctgcgccagaggcgaagcgggcaggtcatgggttgatcggcatgcgcgagcgggtggaagcgcgcggcggcacgctggacatcctgtcgccggcatccggcggctgctgcctgcgcatctggctgccgttgtccggagaggcgtcatgagcgcgaactcgacaccatcgccgctaaccctgttgcgggtggtcggcttggccgcttgtctagctttggcgctgcagcagatcgccatcctatggcccataggagacgccggattggcgcatatgcgcgaacgactgccgctgttgacgggaccggccatcggcctgcccggcgcgatggcggcctacggtttgggttttgcggcgtttggctgggccttgtggcgggccagcgcggttggcgcgcgcgcgccgggggcgacggcgaaagccggcctggtcgttttgcagatcgcgctggccttgctgacaaacgacaagttgctattgctgaccgctgccgagcttgcgttattgttcccgccgcgcgcggcctggctcggcttgggcgggcaagtgctggcgctgctgctggcgtgcgcctggcagctgcagcgtctgccggcgaaggagctgatgtgcaatgtcagcggctccaatgtccatgccccgccgttggagcagcggtcttggttgttgtggcaggacgctgtcgtcggcggtggcttccagctgctgaccttcggcattggttgcctgggcgcggcggaacgccgccgccgcgcgcaactggaagcgacccgcgccagcctgcttgccgcccggcaactgttggccggcgcggccggaaatcgcgagcgggtgcgggtagcccgcgaattgcacgacggcatcggccatcatttgtcggccttgaatctgcaactggagctgttgttgcggcgcggagcaggcgaggcggatgcgccgctgcgcgcggcgcagcaggctgcgcggcagatgctggccgaggtgcggaccctggtgggaatggagcggcggcaacagcaagccccattggcggaggcgctgcgtttgttgtgcgccggcgtccggccgcaagcggagttggtgttggagccgatgccggcgctggcggacgatgcggcgtggcgggcgttttccgcggcccgccaggcgctggagcgcgccggcggccggtcttgccgcctgtggctgcgggggcagggcgaaggcggcgcggagctgcgcctgtcgatgagcggcgaaggcgaatggacgaccgtgtggcaggaggcggcgcgatgatacgcgtgggattgattgacgatcagatactggtgcgcagcggcattcgcggtttgctggagttgaccggcgacatccgggtggcgctcgaggccgcggacggggccgaggcgctggcgctgttgcagggggagaggcccgatgtgctgttgctggatgtgcgcatgccggtcatgtctgggatagcgctattgcaagccctgcagactcgcggcggcatgcccccgaccttgctgctgaccacgttcgatgacgacgaggcgctgttggccggcatgcgtttgggcgcgcgcggatttctgctgaaggacatctcgctggagcggctggcgcaggcgatccgcaacgtggcggcgggggcgaccttgtttcgtccggggctgaccgaacgcgtgctggacggcgtgcgcggcggcggggcaagctttccctccctcgatttgccggaaaggctgactggccgcgaggtggaagtgctggcgctgatggccggcggtttcaataaccgcgagatcgcggaagcgctggggccaagcgagggcacgatcaagaatcacgtctccagcatcttgtccaaactgggcgtgcgcgatcgggtgcgcgcggtgttgcgcgccttggagctgggctacatctgaacccagctccctctctgctcaggcccggctcggttcgcgtctagtcgatgccggcgcgtgtgccggctggctcaccgcctggtgcagggtttccatctgcgcgtccagccggcggatggcttcggcgatgttgtgggtttcgccggacaggctgcgggtggattcgccgacggcgacgatatcgccggcgaactgcgcgaaaccttggttctggcaggtttccgcctgcgacacctggctcagcaggccggccagctcgccggtttcgcggatgatgccggacagcttctgctgcgcgtcctgcgcgttgtcgcggccggcctgcatctggcggttgccgtcgcgcatcgccaccatggcctggttggtgccgtcgacgatcacccggattttgctttcgatgtcctgggtggcgttctgggtgcgctcggccagcttgcgcacttcgtcggccaccaccgcgaagccgcggcccagctcgccggcgcgggcggcctcgatcgccgcgttcagcgccaacagattggtctggtcggcgatgtcgcggatcagctggacgatgccgctgacttcggcgctgcgctggcccagctcttccagccggccggccgcgtggcctatcacttcgccggcgcggcccagctgcgccaccgcctggtccatcgcctcgccgccggccagcgcggcgctgccggcggtttgcgccagctgggtggcggtgctcgactgctcggcgttctggctggtgaccaccgccatctgctgcgccaccaccaccatgttttccgaacgctggtgctgatcggccatggtgcgggccatgctgccggtgctgtcggctatctgtcggctggcgctggaggcgtcgcggatggagcggctgatctgctccatcatctgcgacagcgccaggctggcgcgttcggcgtcctggcgcgcgctttccagtttttcaaagctcttgctcttggccttgtcgaaggccagcgccagcaccagcaccaccagcgacaggccggccagcgacttggcctgcagcttgggcaaggcctcgcgcggcagcgggctggtcggaatgccgccgggcgtcgccgacagccacatcacgacgccgacggcggccagcgacatcgccagccagaacatgccggagcggcgggtgccgatgaacaccgcggtaaaggggatggcggcgaaccacatcaggctggtggagaggatgccgccgttgacatataccatccagcacaccattgcgtacatgcagctggtgatgaattcggcggtgaagcgcaccgcgccgcaaagcttgagcagcagagggccgcacagcaggcccaggccgcccagcgcgatgccttcggccatcggatagtggcccagctccaggtattcgacggcgaacagcggcgccatcaggccggcgagcaggccgacgccgaccacggtgcgggcgcgtatcgcctgctccggaatctgccggaccgcgtccgggatgaaccattctgtgatggcctgtatagacatggattcccctccaaggatgtcccagattgaatcgccctgatttgtaaggttttattgccagggcgcgatggcagccactttaaaacaaatgtttgatcagcggcaatatgcacatcgggtccgcgcgcgaaaaacgcaggatgcgacgggaaggagagggttggagcgaaaaaaatgccgcccgcggcgggcgcgggcggcatcgggaacggcaggccgaggatcagccttgctgttcggcctgcagcgcggtcagcgcgatggtgtagacgatgtcgtccaccagcgcgccgcgcgacaggtcgttgaccggcttcctgaggccttgcagcatcgggcccaccgacaccacgttggcggagcgctgcaccgccttgtaggtggtgttgccggtgttcaggtccgggaacacgaacacggtggcgcggccggccacctggctgtccggcgccttctggcggccgacggattccaccgaggcggcgtcgtactgcatcgggccgtcgatcagcaggtccgggcgcttttcctgggcgatgcgagtggcttcgcgcaccttttccacgtcgctgccgctgccggacgagccggtggagtaggagatcatcgccacgcgcgggttgatgccgaaggccacggccgagtcggcggactggatggcgatgtcggccagctgttccgcggtcgggtccggattcaccgcgcagtcgccgtacacgtacacctgctccggcatcagcatgaagaagacggacgacacgatgctggagcccggcgcggtcttgatcagctgcagcgcggggcggatggtgttggcggtggtgtgcacggcgccggaaactaggccatccacttcgttcatcgccagcatcatggtgcccagcaccacggtgtcttccagttgcgccaaggccatcggctcgttcaggcccttgcccttgcgcagctcgaccatcggcgcgacatactggccgcggatttcgttcggatccagaatctcgaccgatgccggcagcgtcacgccctgggcttcggccacttgcaggatttcggcgcgcttgcccagcagcacgcagcgggcgatgcctttctcctggcagatggcggcggcctggatggtgcgcggctcgttgccttccggcagcacgatgcgcttgttggccttgcgcgccttttccattagctggaagcggaaggccggcggcggcaggcggatttcgcgcggctcgccgacgctttgcttcagcgtcgacacgtcgaggaactcggcgacatgatcgatcaccttgcccatgcgctccaggtcgtcggacggcacctggtggctcatcgcgttcagcgcgctggcggtttccatcgagttcagcgaggtggccagcaccggcaggccgccggtgaaggcttgctggcacagctgctggatgcgcggatccggctcggagtcgcaggtcagcagcaggccggccagcggcacgccgttcatcgcggccatcgaggtggccatcaccacgtcttcgcgctcgcccggggtgatgatcagcgcgcccggcttcagcaggttgacgatgttaggcgcggtgcgggccgccaccaccatattgcgcacgcggcggctggcctgctggccggcgtgcaccacgctggcgttcaggtagcgggccacgtcctgggtgcgcggcgccagcagctccggctggtacgggatcacgcccagcagcgcgaggccggtttttttcagattgccggactgctgcacctcgcgcgccagttcggcgcggtcggcgccgggcagcacatggttgaggatgtagccggcgatggattggccgccgaaggcctggatgttcatttccagctgttcggcgatttccgccgcgcccagatccttcaccgagctgaccaggatggtctgcgcttgcaggttgcgggcgatcttggtgttgaggaaggtggagaacacctgcttctggtccggcaccaggccttccacgatcaccacgtcgacgttttgcgcggcttgctggtagaggctgaccacctcttccatcagctggtcgacctggccttgcgacagcaggtgctcgacgcgctccatgctgatcggctgcggcgggttcaggcggcagatggcctgggcgaagtgggtggagcgctcgacttcgccatccttggtgtcctgggcgatgggcttgacgaagcctacgcgcaggccggcttgttccagcgagcggatcgcgcccagcgacaccgaagtcagaccggcgttgaaaccggttggggcaagaaagaatgtctgcatgatcgcttgctttccttacttggccagaccggccagttcggcggtgtccatggcgatcatcagttcttcattggtgttgatcaccagcgccggcacggagtcggcggcggtgatgcggccggcgttgccgcggatgcacgcttcgttggcggcggcgtccagcttcaggcccaagaagcccagctggttgatgacttcggcgcgcaggaaggacgaattctcgccgatgccgccggtgaacaccacggcgtccagacggcccgcgcccacgctcatcgaggccacgtacttggccaggcggtaggcgaacacttccagcgcgcgcttggcgccttcgtggcccttggcggcggcgtcttccagctcgcggcagtcgttggacagctcggacaggcccagcaggcccgattccttgttcagcatattggtgacggcctgcacgtccatgccgcgctcggtagccaggtagccgaatacgctggggtcgatgtcgccggagcgggtgcccatcaccaggccttccagcggggtcaggcccatcgaggtgtcggcgcatttgccgttgcggatggcggagatggaggcgccgttgcccaggtgggcgatcaccaggctggtttcatcggccggcttgcccagcatcttggcggcttcttcggcgacgaagcggtagctggtgccgtgcatgccgtagcggcgcaggctgttctcgcggtacagcttcatcggcacggcgtacagataagccttttccggcatggtctgatggaaggaggtatcgaacacggccacttgcggcaggctcgggaattcctggatcgcggtgcggatgcccaggatgtgggccggattgtgcagcggggccagcttgatgcagcgttcgatttcgttgatggcgttttcgtccagcagcgccgattgcttgaagtgttcgccgccatgcaccacgcggtggccgatggccttcacgctgtccagcagcgacacttgttgcagtttctcgatgatggcgtgcatggccgcggcgtggtccggagcggacagcagggcggtttgcttgtcgccattgtgtttgaaggtgatgcaggcgtcggccaggcccagtttctcagccaggccggtcatgaccgcttcgtggctggcgctgtcgatcagcgcgaatttcagggaagagctgccgcaattgatgacgaggatgctggaattcataggcttgaacatgtaatttgaaaaaaatgaatgaaatcggtgaaaaaatccacggcgaagtgtttgcgctcaattaactgccgctggcggcctggccggccgcggcgtttccgaggcgggcttcttaccgtgtggtagcgtatcgcggctgctttggctagcctgacatgcagggggcgcgcttcgagggcgccgcagcccgcagccgcattacatcaagggcttagcttgtccggagccggtattttcggaccgggcgccgcttgccggcccgtctgtgatggaattctgacagtcgatgtagtaaggacatggaccagagtataccaccataaattaatagcttctaatgttgcactgcactcaaagtggcaagtctttgatttgcattaactgccgcgcagattgtttgcgatgaggacgcttgacagcgatatcgccccgcaagcgggggcttggcgcggattgtcacatagaattaacgcttgccccgggggaggggcgagggcataattccgccctcgtaatgcaaggttcggccttgttttgattgattgtttttgatagtcccgcaaactcgtcccgagcgagattcggctggtcttatatcttcttccacggaggtgtgggaataatgtctgatctggcttccgcgcagctgctccaagcatctgcagcccagctgcccattcatacctatttcgatcccgggttctacgccagggagcaggagcttctgttcgccgacgctccccagtactacggccacgaattgatggcgcccaatgccggcgactatcacacgctggaatggctggggcacggcaagatgctcaagaacgtcgacggcgagatcaagctgatctccaacgtctgccgccatcgacaggcgatcatctataaaggccgcggcaacggcaaccatatcgtctgcaatctgcacggctggacctacgatgccgctggcacgctggtgggcgcgccgcattttccggaaacgccgtgcctgaacctgggccagaccgagctgacgcgctggaacggcctgctgttcgacgcgcgccgcaacgtggcggcggacctggccaagctgggcgtggccaagcacatggcttttgacggctacgccttccattcgacgcagtccgccgagtacgacttcaactggaaaaccttcattgaggtgtattccgaggactaccacgtcgatcccttccatcccggcctcggcaatttcgtcgactgcggcgatctgaagtgggaatggggcgacagctaccacgtgcagaccgtgggcgtgaaaaaccgcctggcgcgcgccggctccaaggtgtacggcaaatggcacgaggaagtgcgccgccgctacgccgagcagcagccggagttcggtgccatctggctgacctactaccccaatatcatggtggagtggtatccgcacgtgctggtggtgagcgtggtgattccgcgcggcccggagaagtgcacggtgatcaccgagttctactacccggaagacgtggtgtggttcgagccggaattcatcgaggccgagcaggccgcctacttcgaaaccgccaaggaagacgacgaaatctgcatccgcatgcacgagggccgcaaggcgctgtggatggccggcgtcagcgaggtggggccgtaccagtcgccgaccgaggagggcatgcagcacttccacgaatactatcgccgccagatggggttggcattggctggttaaagtggcaagttgaatgccataatgcaggggcgcggaagattccgcgcctttttttatcctcttcaatcttcaaacaacggccaggacgatgtccgcaattctccgcatggttgttttcggcgcgctgctgctgggcagcacgatggcccaggctgccagctatgccgatccggtcagcaaagtccgcttcacgctgccgccgggctggaaggtgcgccccagcatcaccgacggcgtgcgcgtgctgcgggtggtgccgccgaaggccgatcagcgcgagcgcgccgccatcgaggtgcagatcggcgtgcgcaagccgcggcgcggcgacacgctgccgcggctggcggcggcgttccgcaatgaggacggcgaccgcgaggccgccaacttcgtccgcgtcaatccaaaagccggccggctggtgaccgaataccgcgacggccgcttcgtctccaaccggctgtggattgtgcgccataatctgcatgtgattcagctggtggaccgcaatcggctgctggaggcgcgctgcaccgccaacgcgtcggaattcaagacctatcgccggcagatggaggccatctgtctgagcgtggcgctggccaggaagtgaagtcgtcgattttccccgcggggatgggaagcaaaggtaaggatgtggtagcgcagggtaggcagggcggattccggctggggtccggctggatggtggtggcggcggcgttgttcgccttgatggggttgttcgtcaagctgggcgcgcagcaattctcgtccaccgaactggtgttctggcgcacgctgatcggcgtggtcgcgctgggcggcgcggcgctgtggcggcgcgagcgtttcgccacgcctttgctgcgctaccatctgcagcgcggggtgataggctacagttcgctgctgatgtcgttctacgccatcgcccatctgccgctggcgacggcgtccacgctgacctacacctcgccgatgtttctggcgctgctgtcagtggtcttgctgcgggagcgcttgccggcgcaggcgatggccgggctggcgctgggcttcgccggcgtggcgctgctgctgcggcccacgctgtccggcgacgcctggtttgccggcttgatgggcctggcgtcgggctttctggccggctggtcctacctgcatgtgcgcgaactggggcggcagggcgaggccgagtggcgggtggtgttctatttcgcgctgatctccacggtcggcggcgtgctgctgatgtgcctggagcgctggcacccggtgacgctggacaatgtcggcctgttgctgggccttggcgtcagcgctacgctggcgcaattggcgatgacccgcgcctacaaggtggggcgcaagctggccgcggccaacctgtcttatctgaccgtggtgttttccagcctgatcggcgcgctggtgtggggcgacgcgctgtcgccggcgtcgctgctggcgatgggcttgatcgtggtcagcggcatgttggctagtcggcgctagaatacagtcaaggttgccatcaccgtttgaagggagaagtggatgatctcgattcgcgagcaggattatggcctggacgtggccttgttcaatgaattcacgctggccgatttccagctgctggagcaggcgctgctcaagcggctggaagagcgcgacaagccggacatgctgctggacctgtcggagttgaaggacttcacgctggacatggcgctggaagaggtgaagttcatgcgcgcccacgaggagaagctgggccgcgtcgccatcgtggtgggcgacgtgtggatccggctggccacccatatcgccggcctgctgtcgcatacccatgtccagtatttcgatctgaccgaagaggctcaggcctggctggcgcggccggtcgccgcttgattttggcgcggatggcgctacagtagcggtttttgttccattcgaaagaataagaaccgatgctgaaaagcctttccagccgcctggcagctgagcttgccgtccgcgaatcccaggtggccgccaccatcgaactgatagacggcggcgccaccgttcccttcatcgcccgttaccgcaaggaagtcaccggcgggctggacgacacccagctgcgcaacctggccgagcgcctggtctatctgcgcgaactggacgaccgccgcgccagcatactcaagagcatcgccgagcagggcaagctcagccccgagctggaagcggcgctctatgccagcgacaacaagaccacgctggaagacatctacctgccctacaagcccaagcgccgcaccaaggcgcagatcgcccgcgaggccggcctggagccgctggccgacagcctgctggccgatccgacgcaagaccctaacgcgctggcagaaacctacctcaacgccgaagccggcgtcgccgacgccaaagcggcattggacggcgcgcgcgccatcctgatggagcgcttcgccgaggatgccgagctgctgggccgcttgcgcgaaaagctgtggagcgagggcgaattggcggccacggtggtggccggcaaggaaaccgagggcgccaagttctccgattacttcgatcaccgcgaggccatcaaggccattccgtcgcaccgcgcgctggccttgctgcgcggccgcaacgaaggcgtgctgaatgtcgcgttgaaataccagccggatgaaacgccgatcaccgagcgttccggctatgagctgctgatcgccgaccgtttcgatatccgggacgccggccgcgccgccgacaagtggctgctggacggcgtgcgcctgtgctggcgcgccaagatcttcctgtcgctggagctggagctggtgtcgaggctgaaggaagccgccgacgccgaagcgatcaaggtgttcgccgccaacctgcatgacctgctgctggcggcgccggccggccgccgcgcgacgctgggtctggacccgggcctgcgcaccggctgcaaggtcgccgtcgtcgacgataccggcaaggtgctcgataccaccgccatctatccgcacgagccgcgccgcgaatgggacaaatccatcgccatcctcggcgcgctgtgcgcccgccacaaggtagacctgatcgccatcggcaacggcacagccagccgcgaaaccgacaagctggcgcaggacctgatcaaggccttcccgcaactttccatgaccaagatcgtggtgtcggaagccggcgcttccgtttattccgcctccgaactggcggccaaggaattccctgacatggacgtcagcctgcgcggcgcggtgtcgatcgcccgccgcctgcaagacccgctggccgaactggtgaagatcgaccccaaatccatcggcgtcggccagtatcagcacgacgtcaaccaaagccagctggcgcgcgcgctggacggcgtggtggaggattgcgtcaacgcggtgggcgtcgacgtcaataccgcttcggcgccgttgctgacgcgcatctccggcctgaatgcgacgctggcgtccaatattgtgtcctaccgcgaccagaacggcgctttccgcactcgcaaggagttgctgaaagtgccgcgtctgggcgacaaaaccttcgagcaggcggccggcttcctgcgcatcgccggcggcgacaacccgctggacgcgtcgtcggtgcacccggaagcgtatccggtggtggagaagatcgtggccaaggccggccgcgaggtgaaatcgctgatcggcgactccgccttcctgaagtcggtgcgcgcgaccgactacaccgacgagcgtttcggcctgccgaccgtgatggatattcttaaagaactggacaaaccgggccgcgatccgcgtccggagttcaagaccgccgccttccaggacggcatcgaggacatcaagcatttgcagccgggcatggtgctggagggcgtggtcaccaacgtcgccaacttcggcgccttcgtcgatatcggcgtgcaccaggatgggctggtgcatatctcggcgctgtccaataaattcatcgacgatccgcgcaaggtggtcaaggctggcgatgtggtcaaggtcaaggtgctggaagtggatgtggtgcgcaagcgcatcgcactgacgatgcggctggacgacgaggtcggcgcgggtaatagccgcagcggccgaagcgacgcccgcgccgacagccgtccgcgccagcagcgtggccagtctgccgcgccgcagggcgataccgcgatggcggcggccttcgccaaactgcgcaagagctgagtttgactatatagagctattggaacaggccggcgggtgcgccggcctgtttgttttcggggtttgggggcggggctggcggcgcgccatccgttttgtcgatggcttttgcaaataccctgtgttcatatcttcagccagatcatgggcttggcggcgcgcggggcggtttgcgatgaatttttctgatttttcgcaagcaaggtgttgacgggtgcgggtcccgggcgtatagttcgcctcctcagctgacgcagcgaacgaaacggcggaaacgaaacggttccggtgatgacgacgcagcgatcggcaccgctctttaacagacagaataaccgataggtgtaagtgtttggcgaaagccaaaaacttgcactgcaagagacaagagatacttgtttatttctttgaacttgcgtgccagaaaatttgctatgagattgaactgaagagtttgatcctggctcagattgaacgctggcggcatgctttacacatgcaagtcgaacggtaacacaagcaccctgttaccgttcgacttgcatgtgtaaagcatgccgccagcgttcaatctgagccaggatcaaactcttcagttcaatctcatagcaaattttctggcacgcaagttcaaagaaataaacaagtatctcttgtctcttgcagtgcaagtttttggctttcgccaaacacttacacctatcggttattctgtctgttaaagagcggtgccgatcgctgcgtcgtcatcaccggaaccgtttcgtttccgcntcttgggccgagctcacctatccaaagctgggccagcgcgccttcgagccgtgctgtacatggcagcagtggtcgccatacgatacaacccacatgttaaggcgctgtatcaacgattattagcgcggggcaagacgaaaatgtccgccctgggagcagctatgcgcaagctggtccatctgtgctttggcgtgctgaaaacacgccagccttaccgggccgactacgcacgagccgcttgacgtgaaagacggtatctacggtcctgaataatttgcttgaaaccgtagattaggatgaatgaaatgaagcccaatctatggcctgccgctttaggaaacccgagtcaccagtgcaaaacagaggcactcgagagtgagggcctgcccgatgaaaaccgtgacctgccctcccccccgaaccattaacttaacttattaaatgcaaaccattcagtttggcgagttttattgtcctatcaaacaaatcaccatccatcgaaaaaacattatgtgtttgatcatatccaaatcttacaactagccttccatccgaaaattcaagctcacttaacttcctttcacgtaatccaagaattattaatcgccttaactcattctttccaatttttctccctgcaaaaaaaaccacttcattggaaataccaatcaaatcaccaaaccagccacaaaatttcttctcaccaacataatagtcatctaagcaattattatcattcgcatgatcaaaacacataaatggcaacgcatcacactcctcctcattaagcacatggtcatacacggaaatatcagctcgaaatggatattcatcaatcttcacaatactcctcactttctcaaaaccttcccagattcatccaaagttgctactcgccgtcctttcgcatcaaatagcttccaagcactaccaccgtgcggatttccactgcgttcgggagaaatactccatccagttttgggatcaacatagtttgcacctcctcccgactgcttttgacgctggccaaaatccgacaaatcaacaatatctcccttactcaaatctttcccataagagcgcgagtagctacttggatcaattgggtctacgattcccataccttcaagaataaactgaccaaatgccttagggtcattaaatgccttgccagccccctctaaagagccacgaacctctcctgcaatctgacttgccaaatttggcttaccatcaagtgagctatctacaatgggagggattttgccaggtaacgctactggcggtggcgtcattggcaaagcaaagaaattattctccatttccgtcttcgccgcattcaccgtagtcgcggcggtatccgtcgcgccagcggcgacggatgcgccagccagcaggctgctgaccagattctcgcgctgctgcttctcttccgccgtcatcttgtcggagttggtgtcttgcgccttgtccagcgcattgttcaacgccacgctggccgcgccgccaatcgcgcccgccgcgcagctttggctgctggcttcggcgccggcgcaggccagcgcgccgtgcagcaccgcgcgcacggtttcgcctgctaccgttttgtcgcccttttccagctcatccaccatctgcttgatctgctgcgcgcccaggccctgcaggtaagcgatgccggcgttttgcgccatgtcgctcaggctgttgccgacattgccgctgatccccgcggttgccgcggtgaggatctggctgtagcggccgcccggcgcccatttggccgcttggtcggcctgggcttgcaactgggctttttgctcgtcgctcagcgacgggtcggtcttggccctgtcggccaggtccttggccgctttagcttcgaccgccttgttggcggcgaaggtgctgatctggtcggtaaacgtctgcaccacggtgaaggcggtttgcagttgctgcttgtcgaacttgtcctgcaaggcgttggcgccgtccctgtcgctgttgacgccgcgatttaccgccgcggcggcctgggcggcgctttggccggtgagggcctgctggccggcgtcgtcgacgatggcgagcttgccgccgctgatgccggcgcgggtgacgctttcggcgctttggctggaagccatcacgccggacgtgccggcgctgccgccattgccgaactgctgcacgtgggcgccgctgtaattgccgccggacgattggctggcgggcgcgctgttgcctgcggccgccgcggctccgctgctactgctactgctactgctactgccgctggccgcgccgcccttgccgtctccgtctttgccgccgccgcccatgctgccgctgacggccaggccgacgctgctgccggaggacctggcgtggttgtatacgtcgctggtggtgagggtgccggtgctcaggctgttcttgtcgtccgccaccgcccggtcgctgctggcgatgacggcgcccgccagattggtgttgcccttcaccgccacctggtagccgccgtcgccggccttcagcccggactgctgccgcacgctggcgtagtcgttgtccatcttctgctggctgtaattggcgctggcgctgaagccgtagccgatggtgacgctgccggccatgctcttgctgctgctttggtactggtgctggtcttgcaggctttcgatgtccagattgccgccgacattggcgacgatggtctggccgcgcgcttcggcgcccttgagggtggcatcgccgccggacttcagcgtgagggtgtcgccggcggagaccgtggtgtcgcgctggtcgatggtgctgccgttttccttgccgaaggagtggttggcgttggcggtgccgccgaagctgaagccgcccttgccgaaagacacggctatgccggcgccccagccggagctgtcgttttcgccgcgcaggctgctgctgtcctgcgccgacactagctggatctggttgtcggcctgcaaggtggcgttgcggccggcctgcagccgactgccggcgatgtcgatattggagtccttgccgccgccgctggcccgcaggatcaggtcgcgccccgccgtcaggctggtttcggcattggccagcgatttgccttcctcgcggctttcgctcttgctggcgccgaaggtgaggctgccggagatcaattggccgtcggagacggacttggccgactggtagccgttgtaggcggccaggctggcggtgccggcggccagcgcgcgggtgcgggcgtcggtgttcttgttgctggccacttcggccatgctggtgacggcgtcggcggcggccaggatggggctgctgactgcgccggtgatgccgcgctggttcatgcggtgggtttcgctgtgctggtcctggtccacgccgggggcgatttgcagcgatttgccggtcaacgacaggtcctggccggcctgcagcgcggcgcccgccaccgtgatggcgtcggcggcgctgagcgcgacattgccctgctggctttctatccggctgaagccgccgctttgctcgctgccgttggcggccagctggtcccaggtatgctgggcgccgacggtggcgctgtggttgccgccgccgacattgccgaaggtgaggctgtggctgtcctggctgctctggtaatgttccgtgccgcccagcacgttgacgctgccttggctggccgccacactgacatcgtgcacgccctgcagcgtggcgcccaccacgttgacatcgccgcccaggccgaccacgcggatctggtcgccgcggatttcgctggcctgcagctgctggtcctggcggctgcccacgctttcggcgcgcagctggttgtacggcgacagcgaagtgccgttgtggctggggccgccctccagcgcgcggatcacgtcgcccatttgctggttgtacatcgacacgcgggtgtcgtagcggtagctgctgctgtcgtcctggcgctggttgagcccggccagcagattgacgctgccgttggcgaacaggtccaccttgccgccgccctgcaggcgcgaacccgtgatggtcagatcgccgctgccggcggcatcggccggcttgccgctggcctgcaggcggatgtcgccgccggccaggatcgcgctgcccacgctgctgacggtgcggctatgttcgtggctgccctgttcgccgcgggagtaggcgatgtccacgccctgctgcgacgaggtgctggcggcggcttcgttggccagccccttgagcaggccgaagccgcgctgggtatggatcacatccttcaggttgtcgaaggtgtttttcagcgtgttgacctcggtgacgctgaagccgcgctgtttttcgatgtggtcgtggtccaccaccatgatgtcgcggccttcgccgacggcgacgctgtcggcgccaacatcgacattgccgccaagcgcgctcaggctgctgccttgcactttcaagccctgccccgcctgcaccgacaaatcgcccttcaggctgcccaccaggctcttgctctggctttgcgtgacgccgttggcgttgagcgcgtcggtcaactccttgctgcccaccatgaagcccgcgccgcccagcccaaacaagccggaggttttttcgtggtggaactggaagctctggctggcattgaccccggcggcgatgtcgatattgtcgcctgcctgcagcgcgacattgccgctgccggccagctggctgccgacgatgttgaggtcatgtccggactggacgcggagcgtgtcggcggacacattggtgccgacctgggtggtactttgatgcgcgctgatgtcgacggtggttttatgcttgaaaaagccgccggacgagcgcacggtcttgctgtagtcgctatgggcgtcgtcggcggcgcccagatagatgtcgcggccggccagcaaagccgcttcgccatcgctggcgaggctggcggcctgggtgcggatgtcccgcgcggcctgcaatgccagcccggcttcgccatgcaggctgctgccgtgctgcgtcaggtcgtactgattgcggacggtggcgccccagtcgttgtcgctgcggctttcggtggctgccgcccccagcttgatgtcgttgccggcggacaaggccagcttggcatcgctgctcaggctggcgccgttcaatacggcgtcgccgccggcgctggcctgcaggctgcccttgctggataggccggccacggtcaggttgtcggtccgccagttatggctgccgccccagttgtagccgctgtcgcgctgggtatccacctggctttgcagcgtcagctgcttgccggcgatggccgccaggctgccatccgcctgtaccgaagagccttgcaggctgaggtcgccgccggctttcagcacgatgtccccgccttgcagcgtggcggcgtgatggctttgcgacagcgtgtcgtaagcgccgccccgccagctgccggcgccgtgcttgctgtcctgcgtggattccaacgcaaggttgttgccggccgccgccagaatgccgccgcccgccttgacggcgctgccgctcagggtcaggtcgctggcggcgttgaggaccaggctgccgcctatgttcagctggctgcccacatggtccacctgctggtactggaaactgccgtagccgttgccgccgcccaggctatagctggtttcgcggctgccgatgtccagatcgccgccggcctgcagccaggcgttgccgcccgcccgcgcgtccgccgcctgcaatttgagatcgccgccagcctgcagctgcagattgccaccagccagtatgctgctgccggcctggctgtgctgggcgtcgtcggtgaccaccaggttctgcctggcgctcaggcccagatcgccgccggcctgcaccttgccgccttcgatgcggatagcgccggcctgcgccaacagcgtggcgtcggccttcaagacgccgttattgatcagctcgccgctggcttgcaggctcatgctgttgccggccagcaccgcgccctggccgcgcagcgacttttgatcggcgttggccagatagaccatgggcaccagcacctcctggccgcccacgttctgcttcaccagccacaccatgtcggaggtgagcttggccatctgctcggcggacaaggccatgcccggcgtcagctggaattgcttggcgtactgcgcgccgttgctcatcaactgctggtactgctccatcgcgttgcggctgccgtccagcaggcgcttgccagtcagatcggtgacggcgcggctgaccagttgctgctcgtaaaagccgtcgcccagtctcttctccaccttgctcgggtcgtagttcagctgcttcagcaggtagtcggacgagacgaaattcttgtactgggtgaactgcggattggtttccaccaggtaaggctgctgcggcgcgggcttggcgtggaacatgccgttgtccggcaccgcgtagccggccgccaccgggttccccgccttggcgccgccggcctgcaatgtgacctgctgatgggccggcgccggctggtactgcccgcccagctctccctggccgtaaatgcggatggggctggcattggccaacgccgcggcggccgccacgcccagcgcctgcttgccgggctgagccgcggcgtccaccgcctgcgccgcgccctgcgtctggccggcatggtccggcgcgccctggccgccgacgctggccgagtccggcgcccgatcgaacatcacctggatattctccagcgcggcctgcatcgtcgcggcatccacccgcggcgcgcccttgctgttggcgatggtgggcgcttgcaggctcaggtgctggttggtgacgacggtggcatcgagggagccgataacttcagtcgaagtactagctggtacattaaccacccgagtagcgcattgatctgtctttccttttgcacaaagcctatcgacatatggattctcagttccctgcatgaaatattgaacttcagaagttacagtcgtcttctgcaacttctgacctatgttctcaatatttcggcccaccccatacagcccaccacctatagcaactttgctatagcgatttacgacttgatccgcattaacaaccaaatccccaccagagtaaaggttagctgcatttacactggcactagcgcgatcaatagaaattgttttcttcacatcatgaaacaactccccactcacacccttttcatatggaaagtcagcagcacccaattcaactttcttcaccaaacccaaattaaaaacatctaaatcatcatacatatagtctggcttacctgcccgagactccaactcacccctaggaactgccaagaactctggaatcaatctattttgaataacactatcactcggcagaaaatttttggccggatcaaaaccgaccggataaatataccgtgaaccatccctagataaataataataattctcaattgagcttgaggaaaatttagaatcccctctatgatttttaaaaaccatgcgctcaaccgtcagacgatgagttgaactatcatctgaaattagtctatatctaagatcctccgtatcaggagggaaacaatgattcgcagaacagtcataaaaaggatatagcgagctataatcctctcctttcccaaaatcaaacaccccaacataaggtcttgtttctgccatacaatgacctcgcccatcgtgaccacaatacgaggttattgcctttaccatttctgggaactgatatagtgtttttctttcacttgaatctgatgtactaacggtagtaaccaccggattcgactcattactcacccgcccggcgtcaataaacatattgccgtccgactgcaaggtcgcgacgtgattcaccacttggccggttttcgcgccggcctggccgatgcgcatatcgccctggctgtacaaccaggcgccgtcgtggttattcagcgtgccgccaacatccagcgccagattgccagccgaggccagcagcgccttgcccccgctattgtccaggctaccggcatggatggcgatgtctccagcggtgatggaggcggtgttgaccaggctggcggcgttgagattcagcgcgccggcgcccaggttgccgttgttgaccaggctctggctgagccgggtatccagcgcgccgccgatgttgacattgccgttattggtccagttgaggccgctcagcttgaggttgccgccggtttgcagttcgccgttgttgaacaggttgccgctgctgctgatgctaaggttgcggttggcctgcaattgggtgccggcgctgttgacgaagtcgctttgcagcgtcagcgccagatcctgcccggcttgcatggcgccggggttggccagggtggcggcattgaccgccaggttgcgctggctgtaaacgctgccgccgctgttgtccaggctttgggcgttcagttgccagttgccgttgccggcgatatggccgccgttggctaactggccgctcacattcaaggtgctgtcgccctgccccagcgccagcaccttgccgccgccgttctgcaggctgccgctgtccagttgcagggcctggcctgcctgcaacaggccctggctgttgtccaggctggcgccggtcaccgccagcgcgccgttgctgcccagcgtgccttggcggttgttcagcgcgccgccccgcagcgtcaggtcgccctggctgctgagcacgccctgatggttgtcgaggtcgccgctgtcgatctgcagctggccgttggcggtgatcttgccctggccgctgttgtcgatctggccgcggatgtcaagcttggccagctcgccgccggcctggccgatctggccgtgctggttgcccaggctggcggcgctcagcgacagctggccggccaacagctggccgtcgcggttttgcgcgtcctgctcgatctgcgcgctcagcaacgccgcgctttgcagcaggccttgctgattgttcagctggccggcggcgaggtccagcttgccgttgaccgacagcgcgcctttttccgagttgtccagcatgccggacaggctgacccggctggcgtccgcgcccagcgccttgaccgcgccgccgcggttgtccaggctctggccgcttaactgcaggctgtcgccctggatctggccctggcggttgtcggccgcgccggacaaggcgaggcccagcgcctggccgctggccagcacgccgttctggttattcagcgcttgcagccgcaactgctgcgcgccctggctggccagcacgccatggctattgtccagctggccggcgccgagcgtgaggccgccttggctgaatacatggccttgctggttgttgaaatcctggccaatctgcaaagtagccgcgccttggccgacctggcggatttcgccgccctggttgctcaggctgccggtctggatgttcaggctttgggcggccagatggccgccgtcgttgctcaacgcggcttgcttggtcaaattcagcgcgccggcggtttgcagattgcccttggcattgtcgacgcttgccgccttgacggttaggtcggcgttgccggcgatcttgccctggttgtgcagctcgccgctgacgtccagcaggctggccgcatccttgcccagcgccagaacccggcctttttcggcattgctcaggctggatgccgtcagttgcaggtccttgcccgcctgaatcaagccgccgccattctccagcgcgccggccgtcagtttgaccgcgccgtcgccgcccaacacgccgtcgttatgcagcttgccgccgaccgcgagatccacccccaggccgccgaccaaactgccctggctattgtccagcgtcttcagccggctagtcagttgctgctgcgcatacacttcgccagcctggttgctgagcgcatcggcggcgatatccaggctttgcgcgacgatatggccgccatcgttcgtgagctggctttgcttgctcagttccagatggccggcggtctgcaagctgcccttgctgttatcgatggtcgacgcattgaccgtcaggtcggcgttgccggcgagcttgccctggttgcgcagctcgccgctaacgtccaccttgctagcggcgtcctggcccagcgccagaatctggccatggtcggcgttggtgagcgaagcggcggtcagttgcaggtctttgccggactggatggtgccggcggcgttctccagcttgcccgccgtcagcttgaccgcgccgccgccgcccagcgcgccgtcgttatgcaggctgtcggccaccgtcaagtcgacgccctggccgccgatcaggctgcccttgctgttgtccagggtcttgagctggctggtcagctgctgctgcgcatacacctcgccgccctggttgctgagcgcatcggcggcgatgttcaggctttgcgcgacgatatggccgccgtcgttagtcagctggctttgtttgcccaactccagatggccggcggcctgcaggctgcccttggcgttgtcgatggtcgccgcattgaccgtcaggtcggcgttgccggcgagcttgccctggttatggatttcgccatcgacatccagccggctggacgcgtccttgcccaaggccaggatttggcccttgtcggcgttggtcaatgaggtcgcgctcagctgcaggtctttgcctgcctggatcaggccagcgccgttgtcgagctggccggccgtcagcttgaccgcgccgtccccgcccagcacgccgccgtcattgctcaactccccctgaatctgaagcgtcgccgcctgcacgccgaccaagcgcccctggcggttgtccaatcgcgcggcctgcgcatccagccggctgtcgctggcgatgcgtccgtgctcgcggttgtccagctcgccgaccgccagttgcaaggcgccgccgccggcatggctgatgtcgccgccgcggttgtccaggctggcggccagcagccgccactgtccggcggcgctggccagttcgccctggcggttgtcgacggcgccggctatccgccagtcggcattcgcctgcccggtctgcacgatctggccctgccggttgtccagcgcgcccaattgcaactgcacttggctggcggacagttggccatcccgattgtcgaattggccgtcgatgtccagccgggcggcgccagcggcgctcaggcgcgcttgctgcgcatgcaaatcgccggcgacctggacttccagcgcgccgtggctggcgctgagcactgtccccgccaagttggcctgcccggcccgcaggctgacatcgccgccggccagcaattcgccgctgctttgcagctctccgcggctcgtcagcgccagcttgccgcgctcgctcagcttcccgtcggcttgcgagccggcggccagggcgccgtcgctgcgcagggctccggcctccagcgccagatcgccgccggcgctgagcgcctggtgcagcgtggcctggccggccacgtcgatgcggacattgccttcggcgcgggtgatgccctcgtgttgcagctggccgccggcgcgcagcgccagattctgctggctataggttttgccgcgcagaatcaggtcgccggcgctggtcagttccagatcgccggcctgggccgccatcgcgccctgctggttgacgcccacgcccttctcggtgcccaccagcttgatggcgttggcgtacatgccgcccagctgcgccacatccagcgcgaaagccggcgcgtcggcagggctggcctccagcggctgcgcttgcaagctggcggcgtccacctgattgcggcccagcaccaggtccagcttctgcgcgtacaaattggcgttgatcgacgccgcccggctgatgatggcgaagctgtcgacattggcggcattgaggccggccccatcgacgctgacctggccgccggccacccggtagccggtcagcgcgccctgggcgttcagctgcggcgcgccggtgctcagcgtgacctgcggcgtgttgatgaagccgcagccgctgcagctgatgccccaggggttggcgatcaccacctgcgcgcgctggccggccacttccagatagccgcgcagctgcgaagggttggcttgcgtcacctcgttgaggatgatgctggcgctaccgttcttcagattggcgttgccgctgataaagccggccagctgggtgttgacgttgaccgcgctgttgttgagcagcgcgccgccggggccgacgttgaactgcaggtactggttgtgcgacacgccggcggcggtgggggcggcgatctgcaccaccggcaggccgttggcggcctggatcacgccgggctgcttgccggccgccgcgtgcggatcggcgacgatgtcggctgccaaggcgctggcacccagccccaggccgatcagcaatacgctcagcctcagcgagaatgccttgcacgccgcccccagcgtggcggcgacgccctctgcgccgttgcccttgccctgtccgctggcgtcttcctgcaccaccatcaattggccgcgcgattgattgaaaatgatccgataaagatgcttgttcatattgtcagctcaaaaagacgggacagggcagcgggcttaccactgcgcggtgatcgaaaagtgggtgatggccgggcggtcccagccttgcggctggtgcagcgcgcgctcgtgggtcagttcggcggacagatggccgcccaggctcaggcgcaagccggcggcccagccggacaggctgcgctcggggccggtctccccgaccgggcgcgagatctggccggcgtccaggcccaggtagggttccaacgccagcgcgccggccggcggcagcggccagctcagttcattgcgcaggtagtagccgctctgccccaccagcgaactggcattgaagccgcgcacggtgccgcggccgccgatggcgaattgctcgctggacatcagcaggtccggactgtactggccgcgcagttcgctgctccagcgcaaggtctggccgcaggcatgtagcggcagttgcagcgccagccgcccctggtaaagctgatggcgcggattggggccgccttgcgccgcctgggcgtcagactgcgcgccccaggcgccgatgccgcgctgatagccgatggaaccgtccagcaccgcctcgccccaatactggcggtggctgagctccagcccggcgatggtcaggtcgcggcgctgctgcgccacttcggcgtcctcgatgaagctgcgcgacgccttgcgcgtcaggctcagcttgagttcggtcttgccgctctggtcgcgccgcaacagccgcgacagcgacaactgggtattgcggctgtggccgctggaaatgaaatcctggttcacgccctgcaccgtctggcggtaggcgaagccgctgtaactggccatggcggtccaatcgcccagcggcagcagccaggaggcggcggtcgactggctcaagggatggcgcagatgctcggcatcctgagtccacgacagcgccagcacatcgttcaggccagcggcgccgccgatattgaggctggcggcgctttgcagccggccggtggcgcgctggccggagtcgtccagcgtcagcgcgccggacagcggccggccgccttgccgcgccaccaccacatcgctctcgcccggcgcctccgccggcaccatctccatggttgcctgctggcccggcaaccggcccagttgctccagcccttgctccaggtcgcgcacattgagaatgtcgccggggccggatgaaaacgccgaacgcagggccagatcgctgccgccttccttcaagcggatggcgtgtatcctgcccgccaccaccgccagccgcagcgtgccgccgcgcagattctgctccggcagataaacccggctggtgacgaagccgcgcgccaccatctcgttggtcagcgccgccaccaggcgattcagcgcgtccaggcccatgcacttacccagcccggcatccagcagcggctgcagccaacgctgccagctggccggcgcgccgtccagttgcgtctggccgatggcaaagcaagccgccgccggcgcggcgcccggaatggcgggcgctggctttgcgcccgcggacgaaggcagaaagacatccggacgttgctgcagcgactggcgttgctgctcaagttgttgctgctgcaggcgcagcagctgatcggtttgctggatcaaggcaggcggcgcggcggcctggcagatggtggacagcaaaaagccgccatgcgcggcggccagagaacggagtttcatcacaggcggcttaatatttttataaaaaacttaacaattagccgattattttacacttgattaacatgttaaatggataagtaaaaacacttaaacataagacaagaccatgatattcaacacatgtttccctagccgcgccggcaatgaatcaccgcagagcgccatcaaaaacgcaaaatctgctgctgcgtgccaatggggaaaccgtgccgaaacgctctgacctgcgcgcgcagattttgtcaaaagcttagccaaacgacaagaatccggcccggattttgcaaatatggcgctagcgaacttttaccgccgctccagggtaaaaagctctgttccgcgcaacgcaaccacaccatcgtcattcatcatggcaaatacaatcgcgcgcagaggcagatgaaaagacaatggcaacaatccttaccaaatcaataggaagctgtgtcgactcaagactcgcccagccaataaaatgaaattttttcatagctgcccttaactccatcaatgcggcaatgcagcattcacggaaaattccaaaggcattttatttttaccagatatgaattatcaaaaaaacaacacgaatccagataacaagaaacgtaaacaaaatttcataatgcataatttcatccgctcaggagaatgcaacggaatgtgacgcagacaagccgttgatatcaataaaactgccaaatagtatcaatccgcccgccgcgcaatgctgatgacatcccaaacaaaccatccagcttgttaataaatgtttcttgactgggaacttttcatcgcgacacactgcgccttcactacggcggaataaaaaaagcaccgccttggcagatgcccgcgtggcaaatcaaaaacaaagggttttagagaaatgaagaaagctatcctcgccgccgccatcgccgcggccgttcctgcgctcgcgcaagccgatgtcaccctgtacggctcgctgcgcgccggtgtgtccagcaccaagaacagcaccaacaactacaccagcaccttcggcgtggacgacttcggcagccgcatcggcttcaaaggcaaggaagatctgggcaacggcctgaaaaccatctggcaggttgagaccggcctgtcgctggacggcacttccggcttttccagcaccgactccggcaagctggccaaccgcgaatcctatgtcggcgtggaaggcggcttcggcaaggtgcgcctgggctacctgaccgacgtactcggcgacacagaatccaccgacaacctgtacggccccttccgcgacaatatgggtaccggcttcccgctgtacgaagccaccgacgtgttcggcgcctacggcgactcccgcttcaagaacggcatccgctacgactccccggaactatacggcttcagcggcaccgcccagtacggcgccggcgaaagccaggccgccggccagatgaaacagggcgacaaggtcggcctgcgcctcgcttaccagaacagtggcttcttcggcgcctgggcctacgccggcgcgctgaataccaagggcggcagcaatagcgccaccaaccgtctggaaggcggctacaacgccaacaatctgtacctggctgccaactaccagtgggtcaccctgtatggcaatgcccacgcccagaagagcgataactccggcccagtcctcgccggcatcggcaacttcccgaccatcgccactggcaccaacaagctggaaaacaccacttgggccatcaacgccgcctacgctttcggcaacttcaagccgtcggtggtctactccaagcgcggcgacgccaaggtggacggcgtgcgctacagcctgggcgccactcagtgggccgccgcgctggactacaccgtcagcaagcgcaccctgctgcaggccggctacggccaagtgaaggagaaccgcgacgcgcaaaccatcaatggccacgcgcagtccacctcctccacggtatgggcgatgatgaagcacaacttctaagcagtcgtccccggttccggaatgtgcaaacagccaccctcgcgggtggctgttttgcttggcggcgataaaaaagccagcctggctgcaggctggcttttcgacgcgtccgcggctggcttactcgaagaagtcgcgcagcttgtccatgaacgatttggagcgcggattgtgggtggccacatcgccctggctgatggcttcgaactcgcgcagcagctccttctggcgctcggtcagcttcaccggcgtttccacgatcacatggcaatgcaggtcgccgaattcgctgccgcgcacggccttcacgcccttgccgcgcaggcggtagacgcggccgctctgcgtttccgcggcgatcttcaccttggccatgccgtccagcgtcgggatttccacttcgccgcccaaggccgcggtggagaaggagatcggcatctcgcagtgcaggtccatgccatcgcgctggaacaccgcgtgctgcttgatgtgggtgaccacgtacaggtcgcccgccgggccgccgttctggccgggctcgccctcgccgcccaggcggatgcggtcgccctcgtccacgccggccggaatcttcacgttcagcgtcttggtggtcttcttctggccggcgccgtggcagctggtgcatggatcggagatctgcttgccgctgccgtggcaggtcgggcaggtctgctggatcgagaagaagccctggctcatccgcacctggccgtggccgccgcaggtggagcaggtcttgggctgggtgcccggcttggcgccgctgccgttgcaggtggagcaggactcgtgcgacggaatgcggatctgcttctcgcagccgcgcgccgcctcttccagcgtgatttccatgttgtagcgcagatcggcgccgcggtagacgttggaacgtccgccgccgccgccgcgctggccgccgccgaagatgtcgctgaagatgtcggcgaaatcgccgaagccgccgaagccctggccgccgccggcgccggcctgcggatccaccccggcatggccgaactggtcgtaggcgctgcgtttctggctatcggacaggatctcgtaggcttccttcacctccttgaacttgtcttcggcttccttgctgtccggattgcggtccgggtggtacttcatcgccagtttgcggtaggccttcttgatgtcgtcgtcggacgcatcgcgattcacgcccagcacatcgtagaaatcttttttcgacattgtctattcactctccggccggccttgcggccagccctgtcgtcttgatgcggcaaaggcacagaggccggcggagagcctctcccccattccctgtgcctcgttcagcgagatgcgacgattacttcttgtctttcacttcttcgaactcggcgtccaccacgttgccgtcgtctttcttgtcgccggcggcttgcgcgccttcggcgccgccttcagcctgagcggcctgggcgtacatgatctcgcccagcttctggctggccttggccaattcttcggccttggcttcgatggcttccttgtcgtcgcccttgaccacttcctcagccgccttgacggcgtcttcgatcttggccttttcgtcgacgccgatcttctcgccatgctcggacagcgatttcttgatgctgtggatcaggccttcggcgtggttgcgcgcggtcaccagctcgtgcagcttcttgtcttcctcggcgttggcttcggcatccttcaccatgcgctcgatctcggcttcggacagaccgctcgacgcctggatggtgatgttggcttgcttgccggaagccttgtccttggcggacacgtgcaggatgccgttggcgtcgatgttgaattccacttcgatctgcggaatgccgcgcggcgccggcgggatgtcgcccagattgaactggcccagcgacttgttggccgcggccttctcgcgctcgccctgcagcacgtggatggtcaccgcggtctggttgtcgtcggcggtggagaaggtttgcgacgccttggtcgggatcgtggtgttcttctggatcagcttggtcatcacgccgcccagggtttcgatgcccagcgacagcggggtcacgtccagcagcagcacgtccttgcgatcgccggacaataccgagccctggatcgcggcgccgacggccacggcttcgtccgggttcacgtccttgcgcggttccttgccgaagaattccttaaccgcgtcctgcactttcggcatgcgggtctggccgccgaccaggatcacgtcggtgatgtcggacagcgacacgccggcgtccttcagggccacgcggcacggttcgatggagcgggtgatcaggtcgtcgaccaggctttcgaacttggcgcgggtgatcttcatcgccaggtgcttcggaccggtggcgtccatggtgatgtacggcaggttcacctcggtctgggtggcgctggacagctcgatcttggccttctcagccgcttccttcaggcgttgcagcgccatcacgtcctgcttcaggtcgacgccttgttctttcttgaactcggtgacgatgtagtcgatcaggcgttggtcgaagtcttcgccgcccaggaaggtgtcgccgttggtcgacagcacttcgaactggtgctcgccgtccacgtcggcgatttcaatgatggacacgtcgaaggtgccgccgcccaggtcgtataccgcgatcttgcgatcgccttcctgcttggccaggccgaaggccagcgcggccgcggtcggctcgttgatgatgcgcttcacttccaggccggcgatgcggcccgcgtccttggtggcctggcgctggctgtcgttgaagtaggccggcacggtgatcacggcttcggtcacttcttcgcccaggtagtcttcggcggccttcttcatcttgcgcagcacttccgcggagatttgcggcggagccagatcctggtcgcgcaccttcacccaggcgtcgccgttcttcgccttcaggatttcgaaaggcatcaggtcgatgtccttctgcacttccttgtcttcgaagcggcggccgatcaggcgcttggcggcgtagatggtgttcttcgggttggtcaccgcctggcgcttggccggcgcgcccaccaggatttcgccgtcttctacgtaggcgatgatggacggggtggtgcggttgccttcggcgttttcgatgactttcgggttgccgccttctaccactgccacgcaggagttggtggtgcccaggtcgataccgatgattttacccatgatgtattccttttctcgattcgttccggcgccggccgatccgatagccagcgcctgttgtctcaataaatattggctatgccgatcttttcaagaggtcgtcggcagccttttttatgccttggctttcgaaaccaccaccatggccggtcgcagcacgcggtcggccagcaggtagcccttctgcatcacgcgcaccacggtgttcggttcggcgtcggactcttccgcgctcatcgcctggtgctggtgcgggtccagcttgtcgccggccttgggcgcgatgtccttgatctgcgccttgtcgaaggcggacaccagctgtttcagcgtcaggtccacgcccatcttcaaggtgtcgatctggccgctctggtcgagcagcgccatttccaggtaatccttgaccgtcaccagctcggcggcgaatttgccgatcgcatatttatgcgcggcggccacttcttcctgcgcgcggcggcgctggttgtccagttcggcgcgggcgcgcagcagggtgtcgttcagttcggcgatctcggcttccagcccggcgatgtgctgctccggggtctgctccagctcggtatgcgcgtcgctggcggtttcggtcgcttcgttttccacggcttcggccgccgggttctgattttcttgcatgacgtttccttggaattgcaccggctaaatttgatgtccagacccaaggtagggccttttgcatcgatttcaagccctcggcggcgccggtcggcaaaaagacaagaaacgaatatccgcaaatttcaactggcattttttcgtattggcaacatttcaaccagatgaacgattcgtttaagtgaatgaattgttagcttatgaaaacacacgattttttctctgctgcaccgcacacaagcgattttttttgtgcttataatggccgcacaccaaggaaaaagccggctcggcatggcgcgaacgcgctgttcaagccggcgcggaaaatcaggcccacacggcccggtttgacaaaaaaatccggaacaccggatacgccgacacgctattgaggacgccgggcccgcctggcgagcagagaaacgcatcgagaagggttctaacatgacgactcgcgaacaacgcattgcagccatccagaaagactgggacgaaaatccgcgctggaagggcatcaaacgcggctacaccgccgccgacgtcgaacgcctgcgcggctccctgcaggttgagcacagcctggcccgccacggcgcggaaaagctgtggaagctggtgaacaccgagccctacatcaactgtctgggcgccctcaccggcggccaggcgatgcagcaggtgaaggccggcgtcaaggccatctacctgtcgggctggcaggtggcggcggacaacaacgaatactcggcgatgtatccggaccaatcgctgtacccggtggactcggtgcccaaggtagtggagcgcatcaacaacaccttcacccgcgccgatgaaatccagcatgccaagggcctggacaagggcgacaagggctatgtcgactacttcgcgcccatcgtcgccgacgccgaagccggcttcggcggcgtgctgaacgcctatgagctgatgaagtcgatgatccgcgccggcgccgccggcgtgcacttcgaagaccagctggcctcggtgaagaaatgcggccacatgggcggcaaggtgctggtgccgactcaggaggcggtccaaaagctgatcgccgcccgcctggccgccgacgtctacggcgtgccgacgctggtgatcgcccgcaccgacgccgaagcggccgacctgctgaccagcgacgtcgaccccaacgacgagcccttcctcaccggcgagcgcaccgccgaaggcttctacaagaccaagaaaggcctggagcaagccatcagccgcgcggtagcctatgccgactacgccgacctggtatggtgcgaaaccggcacgccggacctggagttcgcgcgcaagttcgccgaagccgtgcacgccaagcacccgggcaagatgttggcctacaactgctcgccgtcgttcaactggaaaaagaacctggacgacgccaccatcgccaaattccagcgcgagctgggcgcgatgggctacaagtaccagttcatcacgctggccggcatccacagcatgtggttcaacatgtacgacctggcgcaggactacgtggcgcgcggcatgtccgcttacgtcgaaaaggtgcaagagcccgaattcgcggcccgcgaccgcggctacagcttcgtgtcccaccaacaggaagtgggcaccggctatttcgacgacgtcaccaccgtgatccagggcggcacctccagcgtcaccgcgctgaccggctccaccgaggaagaacaattccactaaaaccgtcacaaacagcacacaaaaaccggcggaaacgccggttttttattgcgataaaaatgataaattcattaaatgtcgtccacagaccattcaaaacaaatcaaatcgcaatgtctggagatttagtgaaatgaaaaaaatactggctggcagcctaatcatcgccagcagcctgtgcttcaccggctgcacgtccatgcgcgtcatcgccgacaatcagcaagccctgtccagcctggcctcgccgcaacaaagccagctgaaaccgggcgacaagatcagcctcaagaccaccgacggcaaagagtacacgctggtgctgagcgccatcgaccagcaaggcctggaaggcaagctcactgatagcgagcaactcacccggctcgcctggcaaaatatcagcgcggtacaaaaaaacgagattgacggtgtcaagaccgctggccttatcttgctgctgtccggcgccaccttcgcgatcggcaaggctttcctgagcatgttccccggctagccggccgcccgccaacaattgatccccaggaaacatcgatgatcccgactacccctgatctttgcgattcctttgcagacgccgtccgcgtcctggagcccattttccagtcatacggcggccatgcccgcttccatggccagatcgtcacgctgaagctgttcgaggacaacagcctggtgcggcaaacgctgggagaaaacggccagggcaaggtgctggtggtggatggcggcggctcgcgccgctgcgcgctgctgggggatcaattgggcgagctggcggtgcgaaacggctgggccgggctggtgatagacggctgcgtgcgcgacagcgcggcgcttgggcaactgccgctgggggtcaaggcgctggccgcgcatccgcgcaaatcggtgaagctgggcggcggccagagggatttgccggtgcgcatcgccggctgtgaactcgcgccgggccaatggctgtacgccgacgaggacggcgtgatcgtggcggagcgccaactggcctagccgccgccgcgctgatgcaccggcagcgcgccctgggcgttggcggtgccccactccagcctctgctcccaccaggtgtggtgctccggcaccagcacttcggggttgtccagcgaagcggcggtgatgtcgatttcctcgggatcggattcgtggaagtaggtcagcgtggagccgcagtgcgggcagaagccgcgcgacaccgcggcggaggagtgatactgcaccggcttttcgccgcgccattccaattcatgcacccgcatggtgaaccaggtgacgaaagccgccccgctggcgcgccggcagctgcggcaatggcagtgggtgatgtggaaaggcgtgccgcgcagccggtagcgcaccgctccgcacaggcaaccgccggtcaggccaatggtcatgacggctctcccaaggattggggcgcgcatccgggcggcttcctgcgcctgccgccgggcgccgctacgcccctgctctcttcactatgcctgagctatgctgcatgtgcaaaaaaactgtcacgccccgtgctggcgggcagcgggaccgtcgcgttctatactggcggaatgggtattttcccgcggcggatactagacatgcgcgctctttggctttttcccgcctggctatgcctgtccgcgccatgccaggcgcaagcgctcgaccgctcgccgctgcgcatttgcgacgatgccgacgaatggccgccctacacctactatgtccgcaaaaaccagcagcagacccgcgaactgaccggctattcggtggatgtcatcacccgcatcctggacaagcagcgcatcccgttccggatagacctgttgccatggaagcgctgtttgtccgcgatcgacaacgacgagcaatacctgatggccttgagcgccagcaagaatccggaacgggagaagcagttcctgttctcccttccctattaccagacgcactactatgtgttttattcgagagccaagtatccggacggggtaaacgtcgccggccaggccgaccttggccgctaccggctgggcggcgtcaagggctacgcctattccgcgctgaccgcggtcgacaaaaacgccatgctgcgcgccgccgactatccgacgctcgccaggatgctgcaggccgaccgtttcgacctgttcgccgaagactatgaagtgctggccggcctggaccggctgagcgtcacccacatcgtcgacaacccggccatcggccggatgccgctgcccggcatgccgggcaacgccttccacatgatcttcagccgcaagaatcccaggggcgcccagctgcaacagctggtcgaccgggaattgcggcagatgcaggcttccggcgagctggagcagttgctgcggcgctacgtgccgcgctgagcagcgcccgcctcaaaacaaagccgattcgaaatcgtggatggcgtgggccgccaggttgaacagctcggatgccttggccgggtccttcttcaaacccagatcgccgccctcgtaagccatcgccagcgtctgcaaagcggcgggcatctccagcctggccgcttgttcgtaccagccgcgcgcgcgcggcaagtccaccgccacgcccagcccttcctgataggcgatgcccagctggaacatcgcttcggcgctgccccgctccgccgccagttcgaaccagcgcctggccgccgccgcgtcgccgccatccttggcgcgcaggcccagcatgcaggcggcgtcggcttgccggcgtcgcgccgccagcgccagccagcggtcggactggccggcgtcggcggccacgcccaagcccttggcgtagatccgcgccaggcggaacgccgacagcgcgtcgccgcgctcggccgccgcctggtaccagggccgcgccttgcgccagcccgccatgccgccgtcgctggccagcgcctcggccaacgcgcgctgggcgtcggcgtcgtcgttcctggcccaatcctccagttgccgccaggccgccgcgtcgttggcgaactgcgcgtgctggcgggcgtcgtccagctgggcctggctgggcttggcggcgcagccggcgagaatggacaccgccgcgatggcggcgatccatgacatattatgggatttcatcgctgacaaccggcggcggacgccgccggctctgctcctccgtggcgcagccgcgttcacttgctcagatcgaccaggtaggtccaggtgccatcgccgttgtccgccccctggctcacgccattgatgccggcgaggctggccgccgccaactggttggcgatgctcttgaaattgaccttggcgttgatcttgacgaagctccacggccgactgctgccgtactgggcccggcccaggtcgccattggccttgatgtaggcgatcaacacgtcgcggttggcgtcgggggcctggatgatggttttggtgccatctatgccggggaagttgccgccgccgctggcgcggtaattgttggtggccacgatgaactgctgggacggatcgatgggctggccgtcatacgtcaggttgacgatgcggctgcccaccggctggctgacgtcgatctggtactgcactccgtacatcacgtcgaaattgaacacctggaaggcggagttgatcagctcctgcggcgccgacgacgtcgggtccacgctgttgaacatctgcgcggcgcgctccagccagttcttgacatccgcgccgctcaccttcaccgcctgcaccgtgttgggatagaggtagaggtcggcggcgttgttgatggcgatcggcccctgcgccacgtcggtgtagtcgctggcgccatttcggccggccttgaacggcgccgataccgacagcaccggcagcgacgcgtactgcggcaggttggcctgcacgtatttcttcacgtagtcctgctgcgccatattgacgatctggatcgcgctgacatctcccagcaaggcgaagtaggtgttcatgcgaaaatcggtgctgcctatcggcgtcttcacgtaattgatcgtggcctgatgctcgcccgccaccagttgcgcaacgcgcgggtcggccgccacatagctgccgtcggcgttcttgatcgaacgcgtctccaccgccgactggccggtttgcaccacccacttgccgccgctgtatttcagcgtcagccggatcacgcccaggcggttgccccaattgccggccatcaccgtcggcacgccgttgacgaagcccttgttgttgtccacgccctgcatagcgttgaactgcgagccggccgcgcccgggttggggaagatatcgtgcgagtggcctatcatcagcgcgtctatgccggtcttggtcaggtgccagctgccgttttccatcgccgggctgtagctggacggatccagcccgccgtgcgacagcgccaccaccaggtcggcgccggcctggcgcatctgcggcacataggtgttggcggtttccaccacgccgttggtgtagacctggccgttcaggtttttcttgtcccaatccatgatggtgggcggcgtgaagccgatcacgccgatattcaccggcacctgcacgctgctgccgtccggcgcggtgccggcgaaagtgcgcttgagcagggcataaggctggaaaatgggctttttatccgccagattggccacattggccaatacctgcggataagccggcgcgccgcaggcggatggccgcgcgatattggccaggcggaaatcggtattggtgacctgcgacaggaaaggcaggccgaaattgaattcgtgattgcctatggtgccggcatcgtatttcaggtaattcatcaccttgtgcacggcgagcgtatccgcgcatttcaccggattcaccgccgcctggtaatcgcccagcgcggtgccctggatcaaatcgccgtcatccagcagcagattgttcggatactggctgcgcgcctgctgaatcagcgtggctgcccgctccaaaccaaacgacggattggccgccagtttgtaatagtcgtagctgaggacgttttggtggatatcggtggtttccagcagcgccacgctgaccgtggtcccctctgccggcctgcccgacggcgcgctgccgctggaacagcccgccagcagcaggactgcccatcctgccgccgcgatattatgcttgctcatcacatgcctttcttgtcttaccgggtctgaatcgcccagccggcattctattggcttaagcgtcggcattctgcctttgcagatgatttatttatttcaatgcgaagaaaaacggttgaaaaacatcgccagaatgatccaagcgccggattgccgaacaataggcaaagcaaaacaagaaaaatcggccaagaacagaaaattcggatgcattcatttcaacgggggaaatcaggccggccatttgaatcagcgctgtttggaaaataaaaaaccgcctgctgattcagcaggcggctggattccggataaacgatgctcaggccggctgggtcggcgtggcgcccttgacttcggtcaggcggttgtcgccgtcgacaaacaccagcttgggcgagtggttcttcagctccgcgtcttcgtattgggcgaacgaggcgatgatcagcaaatcgcccggcgcggcgcggcgcgcggccgagccgttgaccgaaatcacgccggagccgcgctcggccttgatcgcgtaagtggcgaagcgctcgccgttggtgacgttccagatctgcacttcttcgtattcgagaatgtccgccgcttccagcaggttctcgtcgatggcgcaggatccaatgtaatgcagctcggcgtgcgtggtggtcacgcggtggagcttggacttgagcatattgcgttgcatgacagcttccttgtcgttccggcttagcggaacacttcgatattgtcgatcaggcgggtgcggccgaggcgcgcggcagccagcaccaccaggcgcttttcgccggcgtgagcgatttccagcgtgtccgcctggcgcacttccacgtagtccaccacccagccggcggcggacaggtcgtcgcgcgcggactgttccagcgccgcgtaatcctggctgccggccagcaggccgtcgcggatcgcggtcaggttgcggtacaggcgcggcgcctcggcgcgctcctccgcgctcaggtagccattgcgcgaggacagcgccaggccgtcggcggcgcggccggtgtccaccggcaggatttcaatcggcgagttgaggtcttcgaccatcgccttgatcacatgcagctgctggaagtccttcttgccgaagcaggccaggtccggctgcacgatgttgaacagcttggtcaccaccgtggccacgccgcggaagtggccggggcggaaggcgccgcacagctcgtcctggatgcgcggcggctccacgttgaagtcctgcttgacgcgcggatacagctcgccttcggtcgggaagaacagcgcgtcgacgccggctgcgcgcagcttgtcgcagtccgcctcgaaggtgcgcgggtaggcgtcgaagtcttcgccctggccgaactgcaaccggttgacgaagatgctgaccaccactttgtccgcctggccgcgggcggcttgcaccagcgccaggtggccttcgtgcagattgcccatggtgggcacgaaggccagcttgccggcctgtttccgccaggcgcgcatgtccgccacggtacggatgatttccatcgcttgttctctcccgggcttagtaggtgtgttccgcggtcgggaaggtctgttccttcaccgccttgacataggcttcgacagcgccctggatgctgtcggcctcttccatgaagttcttgacgaacttcgccttcttgcccgggtacacgcccagcatgtcatgcagcaccaacacctggccggaagtatcgacgccggcgcctatgcctatggtcggcgcggaaatggctgcggtgatttccttggccagcgccgccggcacgcattccatcacaatcaggctggcgccggcgtcggacagcgccttggcgtcgttgacgatgcgctgcgcgtcatcgccgcggccttgcacgcggtagccgccgaaagcgttgacgaactgcggggtcaggccgatgtgcgagcacaccggaatgccgcgctccaccaggaagcgggtggtctcggccatgtaggcgccgccttccagcttcaccatgtgcgcgccggcctgcagcaggcgggcggcgtgggcgaaggcttgctgcgggctttcctggtaggcgccgaaagtcatgtcgcccaggatcagcgcgttcttgctgccgcgcgccacgcagcggatgtggtagagcatgtccgcctcgctgaccggcagcgtggaatccaccccctgcatcaccgggcccagcgagtcgccgaccagcagaatctcgacccccgcctcgtccagcagactggcgaaactggcgtcgtaacaggtcagcatggtgatcttctggccttccgcggccaacttgtgcagggtattgacggttattttcatttctcgacttcctcgtgttccatctgcggcgcccagggggacgatgcaaccggtccccggtcagacgctcttgttgaaataactgcgctggccgcgcatttcggcaatgcagcggatcagtagatcgaaatcttcgtcgccgtccaccaggttcagatgatcggtgttgacgatcaacagcggcgacgactcgtactggtggaaaaactcgctataaccggcttgcacgcgcttcagatagccttcggggaagtttacctcgtactccaccgcccgcgcggccaccctttgcagcaaagtgtcttcggacgcctgcagataaatcaccaggtccggcaccgggtattccggcaaggcctggcgcgccaggcgctggtacagcgccagctcgtgctcgtccaggttcagccgcgcgaacagcgcgtccttttcgaacaggaagtccgacaccagcggcgccgccatcagatcgccctgcagcatctcgcgcgccatgtcggcgcgctgcatcaggaagctcagctgggtggacaaggcatgggccggcatattgcgatagaagcgcggcaggaagggattggccgccgggtcttccgccttcagctgcacgccccagtactgcgccagccgggccgccagcgaggatttccccgagcctatcggcccctccaccaccacgtagcgcaattggctcatattattcctgttgttgtcgggttccacggctttcgtccagccgctccacgccggacgcgtccagcgcggccgccagcgcggccacgtcgccgacgcccggcagcatgccggccggggcgatttcggccagaggcaccatcacgaaggcgcgttcgcgcatgcgcgggtgcggcagggtcagccgcggctcgctcattatgacgccatcgtaatgcagaaggtcaagatccaagacccgaggcgcgttgcggaagctgcgctcgcggccgaagcgctgttcgatctcgaaaagcctatccagcagcgccagcggcggcaaatcggtgtcgagcagggccaccgcgttgatgaaatcgggctggtcggcgtaaccgaccggcgcggtgcggtacagcgaggaatggcgcagtagcgtggcgccggccaaatggccaagggccgcgagcgcggccccgacctgttgcgccggctgctccaggttgctgcccagagccacgtaggccagcgtcactcggcgctctccccgcctccggactcgtcgcggcggcggctgttgctgcggcggcggcggcgtttcttggccggctcggcgtcgccgccctgctccttggcctcggcgatcaggcgctcgcactcgtcggcgtcggcgcgctggaagcgctcccaccagctcaccagttgcgccggcacttcgccggcttcgctgcgcagcgccaggaaatcgtaggcggcgcggaagcgcggctgctccaggaagcggtacggccggccgccgctgcggctgtcgaagcgcgcctgcagcgtccagatttcgcgcatggtcacgctgaaacggcgcgggatggcgaaatcgttgtcctgttcggactccacgtcggaaatggcggacaacagcgccggcaggctcttctcgccagcggcgaggcgctgctgccagccctggttcacctggcgccacagcagggtggccagcaagaaaccgaccgaaatcggcttgtcggcgcgcaggcgggcgtcggtgctttccaggctgaggcgcaggaaggcgtcgtcgttgcccttgtcgtccatcaccgcgtccagcagcgggaacacgccgcgggccaggccctcgtcgcgcagcttcttcaggcaggcgtaggcctggccggacatcagcagcttcagcatttcgtcgaacaggcgcgccgccggctctttcttcagcagatgggcgtgggcgcggatcggcttcttggtgtcctcgtcgatctcgaagcccagcttggcggccaggcgcaccgcgcgcagcatgcgcaccgggtcttcctgatagcggcgcgccggctggcctatcatcaccagtttcttggcgtgcaggtccttgacgccgttgtggtagtcgatgacggtttcgtcggacgggtcgtagaacaacgcgttgacggtgaagtcgcggcggtgcgcgtcctcttcctggctgccgaaactgttgtcggccatgatgcggccggtttcattggtgtcgtccacattgccgccgcggaaggtggtcacctctatggtttccggacccatcatcacgtggacgatgcggaagcggcggccgatgatgcgggagcggcggaacagatggtgcacctgctccggcgtggcgttggtggccacgtcgaaatccttgggcgacacgcccagcatcaggtcgcgcaccgcgccgcccaccacgtaggcggcatagccggcttcctgcagccgggaggtgacgcgcagcgccgcctggctcagctggtcgcggcgcacgccgtgttgcggcaacgggaagacgcggggcttgttgcggcgtttgctcatgccggccggcaggtccagtacttttcggattagcttgcggatcatgtggaagattgtgacttggaatgctggattcgcaagattagggattcaaggccgcgattatagcccgattctttacggaaaatacacatccccgccctcccgcgccgcaacttgtttcaatcaagactgtcgcccgccgcgtccgggccaagcagatagccatccaggcattgccgcagatgcgcgcgcagcgccaccaccgccggcgacagcatcagccggtgcggcgtcaccaggaacagcggggtctgctccgtatcatagccgtccagcagcggcaacagacggccggcgcgcagatcggccagcacgtccagccgcgacttgtaggcgatgccgcgtccggccagcgcccagcggcgcacgatttcgccgtcgtcgctctgccagcgcccggccaccgtcaccgtctgccgctcgccgccctgcgcgaagctccagcgctcgtgcaccgccgcgcccaggatgaagcgcaggcattcgcggccgcgcagctcctgcggcgcggcgggcgcgccgtgccgcgccaggtagtccggcgacgcgcacagcacccggcggttgtccggcgccagcggcaaggccaccagcgccgaatcctccggcacgccgtagcgcaacgccacgtccaccggctggcggtagagatcggccacccggtcgctgatctgcagctgcagccccaggcccggatgccgcagcagaaaatcgtccagccagggccgcagcagattgcgccccaggtcagacggcatcgatagcgacaggctgccggacagcgcctgcctatcctgcgccagcgccacgctccccgcccgcagcgcgtccagcgccgcgcgcgcgtgttcgagatagcgctcccccgccagcgtcagcctcaggctgcgggtggagcgcgccagcaattgcgcgcccaccgcctgctccagccgcttcagcgccgcgctggccaccgccggactcagatccagctgccgcgccgccgccgacaggctgccgttgtccgcggcgcggatgaaaacctgcaaatcatcggtcctgaccatttttatcaatatttttttgaaactgattcgaattctagctggatttaatggaaataaaacaggaataccatgcaaaccatcacttggagccgccatcccggcggcccctcagccaagcaaaggaaacgcgatgaaagccgtcgcctactatcagaatctgcccatttcccatccggaagcgctgcaagacgtgcaattgcccgagcccgtcgtcggcgagcacgacctgctggtcgaagtgaaggccatttcggtcaacccggtggatgtcaaagtccgcgccaatatggcgccggaagccggcgaggcccgcgtgctgggctgggacgccgccggcgtggtgaaggccgtcggcagccaggtcagcctgttccggccgggcgaccgcgtctggtacgccggcgcgctgcagcggcccggcgccaacagcgaactgcacgcggtggacgaacgcatcgtcggccgcatgccggacagcctggatttcgaaaccgccgccgcgttgcccctgaccgccatcaccgcctgggagctgctgttcgaccgtctgcaagtgctggccaaccaacagccgtccggcaagaagctgctggtggtcggcgccgccggcggcgtcggctccatcctggtccagttggcgcgccggctcaccggcctcaccgtgatcggcaccgcctcgcgcccggaaacccaggcctgggtggcggagctgggcgcgcatcatgtgatagaccaccgccagccgctgagccgggagctcaaacgcatcggcatcgatcaggtcgattacgtggccagcctgaaccagaccgaccagcacttcggcgaaatcgtcgaagcgctggcgccgcagggcaagctcgcgctgatcgacgacccggctgcgctggacatctcccagctcaaacgcaagagcctgtcgctgcactgggagttcatgtacacccgctcgatgttcaccaccgacgaccagatcgagcagcacaagctgctgaccgagctggcgcggctggtggacgccggcatcgtcaagagcaccgtcgccgagcgcttcggcgccatcaacgccgacaacctgaagcgcgcccacgcgctgctggaaagccataccgccaagggcaagatcgtgctgtccggcttctgaaccccatcgccgaaaaggaaaatgcgaaatgatcgttgaaatcgtccgtctgcgcgtcaagccgggcctatcgcaagccttcgaaaccgcctgggccgaggcatccgcccgctacctgcgccgccagcccggctaccaggcgcacaagctgggccgccagttggaaaccgagcgcgactacctgctggcagtgcagtgggacagcctggacgcgcaccgcgccttcatggaccatgccgacttccagcccttcgcccaaagcttctggcacttcttcgacggcgagccggacctgatccacttccagccgaaccccgcgctatgagcccggccgccgccccgcaaatgaccgccctcctggcgcgcgtccgcgccgccggcacgctggacatcgccaccgaaacgctggcgcaagctcgagcggcggcggagggcctgcgccgctggcaagcgccgccgggctggatccgctgcgcgacgacggcctggattacgccgcggcgctgcgcgcggccggcgtcgataccagctgcatcctgttgtccggcctgacccacgccggcctgcacctgagcggcgtcgtcgcgcaggcgcgccgcctgaccgatctgggcggcgaagccctgcgccgggcgctggcggccgcccctccccccaacgccacggagacgacatgaaccgcccccacctcaccctgatcacgatagacctgtccttccaccacgccagcgccgcggtggtggccgccctgctggaagagcatggcgtggccgtcagcgaatggcgcgtcccgcacgaacgcgcgttcgagctgctgcgcaacggcgaaggcgatctgctgtgcagcgcctggctgccaggcagccatggcgcctatctcgcgccgctggaagacgaagtggaaaagctggctgtgctctacaccccgtacgcgttgtggggcgtgcccgactacgtgcctcaggagcaggttcccagcctggccgacctgaaaaagccggaagtggccgcccgcatgcaaaaaacgatacagggcatcaaccccggcgccggcatcagccgcttttcgctggaaatcatcgagcgctaccggctggacgaagccggctatcacttccgccacggcagcctggacgactgcgccaccgccttcgagcgggcggtggcgaaccaggactgggcggtggtgccgctttggcagccgcagttcctgcactggcggcacagcatccgggaattggccgaccccgaaaagctgctgcgcggcaaggacgaggcgacgctgctgatccgcaagtccgcgctggcgcgcctgccgccggccgcagtcgaggcgctgcgcgcgctgacgctgggcaacccgtcggtggtttgcctagaccaccagatttcgcgccagggcatggatccgctccaggcggcgcggcactggctgcaaaccgcccgcgcggccgcctccgccatcaaagcaacatagcggccggccattcatcaactcagtagacatatggacgaaatccatagagcatacaggcttcagccccatgccacggccatgcgcaccggcgcaggggaagagatcaggaaagccgccggcctttgccggcgggcggcgttccgcaaatccaggagcacgctgtgtattccaaatcgagtccaagcggcggcggacagcctggcggcattgcgcgccggctgccgccacatcatctgaaacatggcgccgcggcgctggccgtcgccatcgcgctggccggctgcgcggtcggtcccgacttcaagccgcccgtcctgccatcggcagccaacggcccttataccgaagccccgctgccagccagcaccgtctccgctcgcggcgagcatgtcggccccgccggcgccagccagcggctggccaatggccaggatctgccggagcaatggtggacgctgttccgctccgactcgctcgatcaactgatccgcgccgcgctggagcacaacccgacgctggacgcggcccaggcctcgctggcgctggcgcgcgaaaactacaacgccgccgccggcaccgcctattacccggcagtcaacgcccagctgggcggcggccgccagcgcgccatcctgaccggcaccagccccagcgagttcaacgtctacaacgccaccgtcaacgtgtcctacacgctagacctgttcggcggcgagcgccgccagctggaaagcctgatggcggccacggactaccagcgcttccagaccgaagccgcctaccagaccctgatcgccaacgtggtgaccaccgcggtgcaggaagcctcgctgcgcggccagctggaagccacgcgcgagctgctgaaggcgcaggaagagcagctgcgcatcgtcgacaagcaggtcgcgctgggcgcgcagccgcgcgcggccgcgctgacccagggcacgctggtggcgcagacccgcgccctgctgccgccgttggacaaggcgctggcgcaaacccgccaccagctggcggtgttcgtcggccgcttccccggcgaaggcggcctgccggaattccacctcgactccttgcggctgccggccgagctgccggtatcgctgccgtccgacctggcgaagcaaaggccggacatccgcgccagcgaggcgctgctgcaccaggccagcgccaatgtcggcgtggccaccgccaaccagtatccgcaaatcaccctcagcggcaattacggcacccagcacaccgttctgccaggcatggacttgggcaacacgctgtggggcctctccgccggcctgacccagccgctgttcaacggcggcgcactcagcgccaagcgccgcggcgcagaagccgcctaccgccaggcggaggcccagtaccgctccaccgtgctgaaggccttccagaacgtggccgacagcctgcgcgcggtggatgccgacgcgctggcgctgaaagcccaggccgacgccgaaacccaggcgcgcgaatcgctgcaggtgcacacccgccagtaccagctgggcggcatcagctacctgtcgctgctggacgcgcagcgcagctatcagcaggcgcggatcggcctgatccaggcccaggccgcccgctacaacgacaccgcggcgctgttcctggcgctgggcggcggctggtggcgccaccccgccgccgacggccagggggccgggggctgagcggcggacaaagcacgcatcgcgcaggccggcgcaaccgcggcggcctgcgccaacacaatccgaattgccatatagagaaaacgaatcatgaccaagcgaatgttgatcatgctgggctgcgtagtgctgctggtagcggcgctgggcgtgggctttttcctccacatccagaaactgatcgccagctcgcccaagcccgggccgcagacggtgtccaccaccatcgccaaaactcaggaatggcagccgcaactgggctcggtgggcaccctcaccgccgtccacggcgtggacatcagcagcgaagtggccggccaggtgcgcgagatcgccttcaagtccggccaggacgtcagggccggcgaggtgctggtgcagctgaacgccgacgctgacgtcgcgcagctgcgctcgctgcaggcggcggccgagctgtccgccaccacgctgaagcgcgaccgcgcccagttggcggtgcagggcgtcagccaggcccaggtggacgccgacgaggccgatttgaagagcaagaaggccctggtggcgcaacaggcggcgctggtggcgaaaaagaccatccgcgcgccgttcgccggccggctgggcatcaccaccgtcaacccgggccagttcctcaaccccggcgacaagatcgtcaccctgcagaccatagacccggtctatgtcgacttcaacctgccgcagcgccagatcggccaagtgcggatcggccagagcgtgtcgctgaagagcgatgccttcggcaacgagctgttccacggcaagatcaacgccatcagccccaagatcgacccggccacccgcaacgtgcaggtggaggccaccatcgccaaccccaagcgcaagctgctgccgggcatgttcgccaacaccaccatagacgtgggcagcaagcagaagcacctgacgctgccgcagaccgcgatcacctacaacccgtacggttcgacggtgttcatcgtcaaggccggcaagaacggccccgaggcgcagcaggccttcgtcaccaccggcgacacccgcggcgaccaggtggccatcctctccggcctgaaggaaggccaggaagtggtgaccagcggccagctgaaactgaagaccggcacgccgatcgccgtcaacaattcggtgcagccggccgatagcccgaacccgacgccgcaagaacactgaggccgcgccatgaactttaccgatatcttcatccgacggccggtgctggccaccacggtgagcctgctcatcgtggtgctgggcctgcgctcgttgttcggcctgccggtcaaccagtatccgcgcacgcaaaacgcggtggtgaccatctccaccgcctattacggcgccgacgccaagaccgtggccggcttcatcacccagccgctggaatccgccatcgcccaggcgcagggcatagactacctgtcgtccaccagcaccagcggcgtgtccaccatcaccgccacgctgcggctgaactatgacgcaaaccgcgcgctgaccgagatcaacacccaggtcaactcggtgaagaaccagctgccggcccaagcgcagcagccggtgctgacggtgcagaccggccagaccaccgacgcgatgtacatgggcttctacagcgacacgcttccgaccaacaacgtcaccgactacctggtgcgggtggtcaagcccaagctggactcggtgccgggggttcagacggcggaaatcctgggcgcgcgccagttcgcgctgcgcgcctggctggattcggccaagatggcggcgcacggcgtcaccgcggccgacgtcagcgccgccctggccaacaacaacacgctgaccgcgctgggcgccagcaagggccagatggtgaccatcccgctgaccgccgccaccgacctgcactcggtcgacgaattcaagcagctggcggtcaagcgcaacggcgacgccatcgtgcggctggaagacgtggccaccgtgacgctgggttcggaaaactatgacttcaacgtcgcgttcagcggcgtgcgctcggtgttcatcggcatcaaggtggcgccggaggccaacatcctggatgtggccgaacgcgtgcgcacggtgttcccgtccatccagcagcagctgcccaccggcctgaccggccagatcgtctacgactccaccgacttcatcaacacctccatccacgaggtggtgaagacgctgctggaggcgctggtgatcgtgaccgtggtgatcttcctgttcctcggcagcttccgcgcggtggtggtgccggtgatcgcgatgccgctgtcgctgatcggcaccttcttcatcatgctgatgctgggctactcgatcaacctgctgacgctgctggcgctggtgctggccatcggcctggtggtggacgacgccatcatcgtggtggaaaacgtcgaccgccacatgcgcgagggcaagacgccgctcgaagccgccatcatcgccgcgcgcgagctgggcggcccgattctggcgatgacggtggtgctggtggcggtgtacgtgccgatcggcttccagggcggcctgaccggcgcgctgttcaccgaattcgccttcacgctggccgcctcggtcaccgtgtccggcgtggtggcgctgacgctgtcgccgatgatgtgttcgcgcttcttcaagtcggacatggacaacagccccttcgtccacgccatcgaccgcaccttcgaacgcgtgcgccaccgctaccagcgcatcctgcgcagcctgctgcagacctggccggtgctgatcgtgatgggcgtgatcctgatcgcgctcttgggcctgatgttcaagatgtcgaagtcggagctggcgccggaagaggaccagggcatcgtgctgtcgcaggtggtgggcgcgcccaccgccaccgccgaccagatgcaggcctacgccgaccaagtgttccaggtgggcaagagcatgccggaatacaagcagatgttccagatcaccggcgtgcccaccaccaacgccggcatcggcggcgtgctgttcaaggaatgggaccagcgcaagcgcagcgcgcatgaaatccagctggacctgcaggcgcgctggaacaagatcgccggcgcgcgcgtggcggccttccagttccccgccctgcccggcgcgtccggcctgccggtgcagttcgtcatcaccaccaccgagccgttcgagaacctgaaccaggtggcgcagcaggtgatggacaaggcgcgcgcctccggcaagttctacttcgtcgacgccgacctgaaaatcgacaagccgcaggcgacggtggtagtggaccgcgacaagatcaccgcgctgggcctgacccaacaggacgtcggcaactcgctgtctgcggcgctgggcggcggctacgtcaactacttctcgatcgacggccgctcctacaaggtgattccgcaggtgctgcaaaccgaccggctgaatccatcccagctgctggattactacatcaagacgccgaacagcggcgtgatcccggtgggcaccgtggccaagctgaaatacgacgtggtgccggagtcgatcacccgcttccagcagctcaattcggtgaccatctccggcgtggccggcgtgtcgcagggcgaagtgctgcagttcatgcgcgataccgtgcagcaggtcgcgcccagcggttacaccgtcgactactccggccagtcgcgccagttcatgcaggagtccggcggcttcctggtgacgatgatgttcgcggtgatcatcgtgttcctggcgctggcggcgctgttcgaaagcttccgcgacccggtggtgatcctggtgtcggtgccgctggcgctgttcggcgcgatgatcttcatcttcctcggtttctcctcgctcaacatctacaccgaggtggggctggtgacgctgatgggcctgatcagcaagcacggcatcctgatcgtggaagtggccaacgagctgcgcaagaccggcttgtccaagcaggacgccatcgagcaggctgccgccatccggctgcgcccgatcctgatgaccaccgccgcgatggtgttcggcgtgattccgctggtgatcgcctccggtgccggcgccgccggccgctacgcgatgggcctggtgatcttcaccggcctgtccatcggcacgctgttcacgctgttcgtggtgccggcgatgtatatgttcctggcctccaaacgcgaaaccgccgtggaaaccgccggcgacgccgcgctggaaaaccagccgcgctaagccagccgcgccattcgcgccgggcggctcctttgggagccgcccgttttcatttgcgccgccaccgggctaggccagacagaattcgcgcaccaacgccaccagttcatccggccgctccagaaaagcggcgtggccgctgtcgatttcgacgcagcggctgcccgggatcagctgatgcagcccacgcgtctggtaaggcggcaccaggtaatcctggcggcacgccaccaccagcgtcggcgccgcgatcgtccgcgccgcttggcggatatcgatgcgcaggcccagttcgacacggcgcgccgtgtcgggcggcatgggctggcgcagcaaggcgtcgatgctgtcgccgccaaaccgggtcagcgcggccgggctgaccgcgagcgcgaaggcatagcggttgcaaagctcggcgtccgccgccagaagccgccgccagccttcaaacaccatctggtggcgggcatcgccgctgtccgcccagccggccaccaggatcaggcgccgcacccggtccgggtgccgcgccgcgacggcggccgccaccaccgcgcccagcgaatcgcccaacagatcgaccggctcgtccgcagcatggcggatcaccgccgcgacctgctctaccaaaatgtccaacgtcagttcgccgtccggcagagtggagccgccgcaaccgccgtaattgggcatgaccacctggcagtggtcggcgaaacgttccgccacttggccgaaattgccctgcgcatcgacgctggtgccgtgcaacagaaccaaaggccggccaacgccgctgcaggtataattgaccgaagcgccggccgcctgaatggtgatgctcatgcgaaacccctttgccagaaccaagctggccggcgcggagaaggcgcgcagcagccaacatgccattaccacacgcaccggccgccaaattattccaaatgactcaatcattgcgccatgctccgccaaaatcgcattcccggacggggcagtcatgacgctggcccgcgctgctgcatcgcccggccggcggcgcagcccgaaatctgccgcaggcgcggcaagcaaagcgaaaaaatgaaacagaccatggaagcgcgccgcgtcagcggcctgattctggccggcggccagggcatgcggatgggcgggcaggacaagggctggctggaactggtcggcgcgccgctggtcgagctgacgctggcgcggctgcggccgcaattggcaaacggagagttgctgatcagcgccaaccgcaacctggaacgctatgccgcgctggcccgcgcgctgccggacgcgccggagttcgccggctgcgggccgttggccggcctggaagccggcttggcggcttgcgcggccccctggctggtggcggttccctgcgacctgcctttcctgcccgccgacctggcctcgcggctgctggcgccgctgctgcgcggggaggccagtctgagcgcggccagctgcgccggccggcagcacccggcctgcatggctttgtcggtggagctgctggaggatctgcgcgcctatctgcgcgccgacggccgcaaggtcagggaatggcaggcccgcgtcggcgcgctgcagatagatttcgacgacgcgcccgaggcctttcgcaatctcaataccccggacgatctggccgcggcggaagcctacgccagccagtggcgccagtcgtaataggcgaccctgtcgccatcggccagttgccggtccgccggcagcctggccaagcccgacgatcccggcagcgcgctgataatgccggcggcctggcggccatgcggatgcagccgcgcgtcgctttccagccgcacccgcaggaagtcctctcggccgcagtccttgcgctgcgcgccgctggccaggggcaattggcccaccggcgggaagcattcgccgcgcccctgcatccgccgcatcaacggcgtcaccagcaaggcgaacaccacgtaggccgaaaccgggttgccgggcaggcacaccaccggcgtcgcgcccagccgggccagcgccaccggcttgccgggcttcatcctcaccttccataaatccagctccgcccccaatccggccagcaccggcttgaccaggtcgcgctcgcccaccgacaccccgccgacgctcagcaccaggtcgcattcgcgcgccagctcgacgaaggcctggcgcagctcgtcctcgacgtcgcgggcatgccgccgcgccgccacccgcgcgcccatgccggccgccagcgccgccagcatcgcgccgttgctgttgtagatctgctgcggcgcgcgcgcctcgcccggcgcgaccagctcgtcgcctgaagtcaggatgcccaccttcaggcgcgggaacaccgggacttcggccatcccttgcgacgccagcaaggcgatatggccgggccccagcacgcagccggcctccagcaggatcgcgcccgccgccacatcctcgccgcggcggcggatatgctggcccggcagcggcgggcggctgatcgtcaccatgccgtcggcctcttccgcgtcctcctgcatcgccaccgcgtcggcgccgtccggcagcaggctgccggtgaacaagcggatagcctggccgggcagcaaggcctctggcgcctggccggcatagcaacgctgctgcaccggcagcgccacgcccggcgcggcgtcggcgcaacgcaatgcgtagccgtccatcgcgctgttgtcggccggcggcatgtccagcgccgccgtcagcgtccgtgccagcacccggcccgccgcttcgtccaatcgcacggtttcggtccccgtcaacggcggcgcgtaatcggccaggtagcgctgggcatcctcgaatgccaacatcagctctcctccttgacgcggaaggcgctggcgaaattgcagggctggtggcggctgtccagctgctcgcgcagtatcttgtcccaggccagctcgcacgcccgctccgcccccggcaggcagaagatcagcgtgcggttggcgaaaccggccagcgcgcgcgactgcagcgccgaactgccgacctgcgccagcgagaaatggcggtacagctcgccgaagccgtctatctccttgtccagcagcggcagcaccgcctccggcgccgagttgcgcggcgagaagccggtgccgccgctggtgaggatcacctgcacctcgtcctcggctatccattcgctgagcacgcggcggatctggtagatattgtcggcgacgatgccgcgccgggcgcagacatggccgtcctggctcagtttttccgccagcaggtcgccggcgccgtcgttgtccagggtgcggcggtcgctgatggtcagcaccgcgcagcgcagcgaaaccgcttgttcgtcatgcatttcgatgacctttctgtaagtgcctccggacctcagcccgcggtgtattcgacaaagccgttcttgcggcagaagctggccagcgacattccggcctggcgcgcgatgtccaccgccagcgaggtgggcgcggaaatggtggccaacagcggaatgcccatcctggccgccttgcgcgccaactcgtagctggcgcggctggacatgaacacgaagccctcatccagcgccgcgccctgcagcgccagatggccgatcagcttgtccatcgcattatggcggcccacatcctcgaacgcccgcagcaccgcgccgtccggcccgcaccaggccgccgcgtgcacgccgccggtggcgcgcatcagccgctgatgctcgggcaactcgcgcgcggcgcgggcgatgatgtcggcgcgggcgattatccgccgcgccgcggcgatcggcgtcggcgccaggtcgagcaaggccaggctctcgatgccgcagacgccgcagccgctgcggccttccagcgagcgccgcctctccttcaaacccaaaaaagccggctgggcgatctccagcctcacctcggcgccgctggcgaaaaactcggcctcgacgtcgaagatctcgccgcgccgcgccacgatgccctcggtcagcgcgaagcccaccgccagcgcctccaggtcgcatggcgtggccatcatcaccgcgtgggaaatgccgttgaacaccagcgccaccggcgtttcctccgccacccggtccgcgtcggcgcgctgcccgccgtcttcctgatggcgcgtcaccgcgcattgaatgaaaccgtcgccctcgcccattggctgctcccgcatatcgccctctcccgccatcccgccaccggcgcgcgccggcatttccgccgcgccgcaatccgcctacactacaccgcctgccacctccgaccgacgaaccatgacccagccctcgtccgatcagctcgaccccgccatcgccgccctgctggcgcagctatggcgcgccgcccaatccggcgggccggcctggtcgctgccgcggctgtgcaaacagtccggcctgcgcatgagcacgctgcggcgcagcctgaccttgctcgccgaactggagctggccgccatcgagctgtacgccgacggccgcggccgcgcctggctcagcgacgacggcctggccttgtgccgccagctgttcgagcccggcgacgaaggctgacattatccccccctgccgaacggggcgccagccgccgcgccggaaactcccaccaaagcggccgcatgctttatccttgcatcccgacgcggggcgccgccccgcccttaacccacccgccgcaggagcctgtttcagcatggaccattccaagaccaagggacgaatcgaaccctacgcgccgccggccggcggcctcggttcgctgaaaagcaccaccgtcgccctggtcaaggaaaaggtgccgggcagccgctacaagacgctgttccatcagaaccagcccgacggcttcgactgcccgggctgcgcctggcccgaccgcgaacacacctccaccttcgaattctgcgaaaacggcgtcaaggcggtggcggcggaagccaccggcaagaggataggcgccgacttcttcgcccgccacacggtgacggcgctgctggaacagtcggactacgaactggagcagcatggccggctgaccgaaccactggcctacgacgccgccagcgaccgctacctgcccatctcctgggacgacgccttcgcgctgacggcgcgccacctgcgggcgctgccggaccccaaccaggcctcgttctacacctccggccgcaccagcaacgaaaccgcctacctgttccagctgttcgtgcgcatgttcggcaccaataattttccggactgctccaacctgtgccatgaatccaccagccgcgccttgccggccacggtgggtgtgggcaaggccacggtgatcctcgacgatttcgagcacgccgacaccatcctggtattcggccagaacccggccaccaaccatcctcgcatgctgaacgagctgcgcgaatgcgcgaagcgcggcgcggccatcgtctccatcaacccgctgaaggaacgcggcctggagcgcttcgccagcccgcagcatccgctggacatggtgggcggcggcgtcgccatcagctcgatgttcatccgcccgaccctgggcggcgacttcgcgctgatcaagggcgtggccaagcgggtgctggagctggacgacgaggccgtggccgccggcggcgagcgggtgctggatgccggcttcctcgccgagcattgcagcggcttcgacgccttcgccgccgacttgcgcgccgaaagctggccggcgctggcggccgattccggcgtgccctggagcgacatcgacgcgctggcccggctgtacgcgcgcggcaaggcggtgatcgccacttggggcatggggctgacccagcacaagaattcggtggcggcgatacagatgctgtccaacctgatgatgatgcgcggcaatatcggcaagcgcggcgccggcctatgcccggtgcgcggccactccaacgtgcagggcgaccgcaccgtcggcatcgaggacaagccaaccccggccttcctcgaccggctgcgcgacgtctacggctttgagccgccgcgccatcacggcctggacgccgtcgacaccatcgccgcgatgcgcgacggacgggtgaaggtattcgtcggcctgggcggcaatttcgcgatggccacgccggacaccccgctcaccttcgccgcgctgcgcaactgcgcgctgacggtgcagatctccaccaagctcaaccgcagccacctgatccacggcaaggacgcgctgatcctgccgacgctgggccgcaccgagatagacctgcagaaaagcggcccgcagggcgtgacggtggaggactcgatgtgcatggtgcatctgtcctacggcatcaacccgccggcctcgcgcgaactgcgctccgaaaccgccatcgtcgccggcatcgcgcaggcgacgctgggcggcggcaaagtggactggctgagcttcgtcgacgactacgccaaaatccgcgacgagatcgccaaggtgctggacgccttccgcgacttcaacgcccgcgtggcgaagccgggcggcttccacctcacgcccgcctcgcgcgagcggcgctggctgaccccggccggcaaggcgcagttcatcgtccacgcgctggagcgcgacacccccatccagcgcgcccgcgcccgccacggcgaccaactgatggtgctgatgaccgcgcgttcgcacgaccagtacaacaccaccatctacgcgatggacgaccgctaccgcggcgtctacggccagcgccgggtgctgttcatccaccgcgacgacctggcgcggctgggtttttccgccggcgagcgggtggacctgttcacagtctgggacgacgacgtggagcgccgcgccgacggtttcctgctggtggaatacgatattccgcgcggctgcctgggcgcctacttcccggaaaccaatccgctgatcccgctagacagcgtggccgacgtctccaacacccccacctccaaatcggtgccggtgctcctgcgccgcgccgccggctgagcgcccgcgcgaccggccctcagccggccgccaccaggccgcggacgatcgctatcgcgtcgccgaactgcaggcgctgcacgcaggcggccgcctggcgcacccgcgcctcgctgtcgcccagctccaacgccagcaattcttcgatcaggtctatcaccgccagattgtggtcttccagcagcgccagcacatcccgcagccggtcccgctccagcgcgagcgcgccggacgccggcgcgctccgcgcttcggccggcagcgacgccgccagctggccggcgctgctgtcggccagccgctccagttcgcgcagccggtcggccagcgccgttgccgccagccgccccggattgccggccttcaccagccgcgacagctcctgcgcctgccgattcagcgccgtcgctcccatggtcgccgccacgcccttgagcgcatgcaggctgaccagcaagccgggccaggcgcctttgtccacctgccgctccatatcagccagcagcctttcgcactccggacggaaagtcgccagcgccgcgcggtataccttgagcttgttgccgaagcggcgcagccgcgaaggcagcgcctctatcgccggcccatcgtcgctcccgccgtcttcgccttccccgccggtcatctgcgtattacgcgcctgccagccggccagcgcctgcagcttggccaccagttcgtctatgtctatcggcttgccgacatggtcgtccatgccggcggccaggcattcgtcgcggtcggcccgggaggcgttggccgtcatcgccagtatcggcagcgcctggcagcgcggatcggcgcgcaggcggcgcgtcgcctccaggccgtcgatatcgggcatctgcacgtccatgatcaccacgtcgtaaagcggatcggcggcgctggccagcgccaccccctgcaggcctccctccgccagcgcgacctcggcgccttcgtcgcgcagcaattccatcgcgacctgccgattcaaggcgttgtcctccaccagcagcaggcgcaacccggccagccgcctcggcgcggccggcggcatcgcctcgcacaaatcgttatccgcgcccgccaccgcgcggcgaatggcgtccaccagctgctgcggcgtcaccggcttggtcagcacgtcgcagaacggtgcctgcggctgctgggcgatgcccgccagcacctcgcggccgaaggctgtgaccatcacgatcaccggcgaatggttgggcgcggcctgctgccgcatgcgcctggccgtttccacgccgtccagccccggcatgcgccagtccatcaacaccacgtcgtagcgccagccgccggcgatggccgcgcgcgccaacgctatcgcctcttcgccgccattggcgtaatcggcatgccagcccaccaaggacaaggtgtcgagcaggatctccccggccagcgcattgtcgtccaccaccagcacccgcaggccatcccccggccaactggccgccagcgccgcgcccccgctcaagccgaaggccagctcgaaccagaagcggctgccctcgccgggccggctctccacctgcaggcggccgcccatcagctcgatcagccccttgctgatcaccaagcccagcccggtgccgccgaaccgtcgggaggtggaggcttccgcctgggagaagccttcgaaaatgcggttcaattgctcggcgctgatgccgatgccgctgtccagaatctcgaaccgcagcacgacgtcgcgctcgccgcgccgcgtcgccgacaggctgaccaccacctgtcccgccacggtgaacttcagcgcgttgccggccaggttgatcaggatctgctgcaggcgcagccggtcgccatacagcatggaaggcagggtcggatccatccggaacagcacttccacattgcggtcgccgtgattgcccgacagcaccaccgccagatcgcgcatcaggctttccaggtcgaaggggtgcgggtccagctgcagcttgccggcgtcgatcttggagaaatcgaggatgtcgttgagcaggcccagcaaagagcgggccgccgcctgggttttttcgacgtagtcgcgctggcgcccgtccagccccgtgcgctgcagcagctgcagcagacccagcaccgcgttcatcggcgtgcggatctcatggctcatattggccaggaactggcctttggcgatgctggcctgctccgcctgccgcttggcctccagcaaggtggcttcgtaggcctggcgctcggtgacgtcctcgcaaatgccggtgaagcgcagcgcgcgcccgtcgccgtcgcgctcgatccgcgcgccggcctgcaactggcgcacctcgccgttaggacgcaccacgcggaaggcggcgtcataggccccgccttccgccgccgccgccatcatgcctgcctccatccgccgcgcgtcgtcgggatggagccgctccagccagctccggtactccagttcctgccgcgccggctccggttgcggcgccaggccgtggatttcgaacatcctgtggttccagttgagcatgccgtccgccggcacccagctccacacgcccagctgcgcgacatccgccgccatttgcagctggtcgcgcgccactgtcagttcctgctgctgctgcagctgggcggtaatgtcgacggcgatgcccagatagccgttgatccgcccctcgtcgtcgcgcatggtggtcaccaccagcgatatcttcagttgcgagccatccttgcgcagataggtccattggctatgatcagcgcccaggatttccgattcatggacgaaaatgcggaagccttcgataggctggccgtaacgctcgctcaactcccgtccgcgggcggcgatctcctccgccggatggaagcgtcccggcgtgctgacgccgaccagctcctccgcgcgatagcccagcatgcgctcggcgccgcggttgaacagggtgatgacgccgtcgacgtcggtggcgatgatggaaatctccgacgccgcgcccagcacatcgctcagcaggcgattgacccggcccagctcggcgtcggcgcgccgccgctcggtggtgtctatgctcaacgccacgcagcggcccaggctgccatcggcgcccagctgcggcgcgatcacggtgtccagccagcgcaggccgccgtcgctggcgcggttgcacatttcgccgcgccaggcctcgccgcggcgcagcgcatccgataacgccgaccagaacgccggcgtctgcccgccgccgtccagccattgcagatcccggcccagcagcgcctcgcgcgcgtagccgtggctgcggcagaacagatcgttgacctccagcagccggccgtcggcgccggtcaccgagtacaggagttggcgattgatggtgctcagcagcaagtccacctcctggcgcgcgcgcgcctggcggtcgcggctttccaccagttcggacacgtcgtgcaccaccgcgtagaaaccttgcacttcgccgtcgacgatatccggcagatagtgggtcagcgcgtcgcgcacccggccgtccggcccgggaatccgccgctcgaaggtttgcggttcgccgcgcagcgccgcctcgatgtaaggctggttagcgcggtaaagctccgctcccagcaactcgcgcaatgacaggcccggcaggctgtcggcggccaccccgaaccaatccaggtaagcccggttcgccacccggttgatctggccgcggtcccaatagccgatcagcgacggcaccgcgtccaccaccgtccgcagggtatgcctggccttgcccagctcggcgccgcgttcggccaccagctcctccaggtggctgttcaggctgtgcagctgcgcctccacctgcttttgccggctgatgtcccgcaccgaggtggacgctccggccacctcgccggcggcgtcgcgcaccggcgagatggaaaccgacacgtccaccaggctgccgtccttgcgccgccagcgggttgcgaaatgctcgaccggctcgcccctgccgacccgcgccaggatgtcctccacctgggactgccgctcctgaggcaccaccagccccgccagcggccggcctatggcttccgcggcggaaaaacccagcatccgctccgcgctgcggttccagtcggtgatcacgcccgccagcgtcttgccgatgatggcgtcggccgagttctcgacgatggtggccagccgcgcctgggtggccgccagctgcatccgccgctggtggctgcgctgccagatgaaagccaacagcgcgccgagcaggctcagaaacgcgccggccaggccggccgccgccggccgcggctgctgcagccgggcggcgaagccaggatatgcgcgcagcgtcagctgccagcgccgccccagcaccaactggtattcggaatagctcgccagcgcttgcccggccggcgccgcgctggcgtacaccgcgatcggccgggccgggtcggtgacatcgttcagttccacccgcacgccgccttgctcctgctccagtcctcccatcacggttttcatgtgcaggggaacgctcacccagccgtagccttgctccattctggcggcgccggtggcgggcaccacgccgccgcgatagaccgcaagcagaaccacaaaagccggatcctgggccagcgaacgctgcaccagcttgatcggcgcagtcatcgtcatctggccgctgcgcagcgcctgctccgcggtggcgcggcgattgggctccgaggcaatgtccagaccgaccgcgcgcagattgcccagctccggctggatgtaggccacgacatcgcgctcgccctgatgcggctgcaactgccagatgcggaaatcggacatgccctcgcgccgcatccggcgctcgaacgccgcgctttgccgcagaggcaccctgaggatgtaaccaaagccctgcgccccagggaattcggccgcgatgtcgcgcccctcgctgtaatcgcggaaacgttcgcggctgaggccgcgctcgcccgccgccatggccaccccgcgcatcgccttcaggccgaactgatagcgcagcacccggtacgccacctgcctggccatccgctgcgtcgcgctccgcaccgccagttggacatcggcgtcgttctggcgcgccaattgccaggataccagggcgctcaatcccagccctgccagcaaggccagcaaggaccagctcaatgcgaaaaaagaacggccatggctggcccgagcgcccgattccccgtccaccctatcctcccgtgtgcaaaccgccgccgtccgcgcctcaggcctggctgccggccaggcgggcgccattgcccaactggcgatccatctcttccaccggcaccggcctgccgtacagaaagccctgcatcacgcggcagcccagcgcgagcagcgccctctcctgctcggccgactccacgccttcggccaccagttgcagatccaggccctgggccatgctgacgatggcggagatgatggcgagattgctcttgtcccctatcatgtcgcggacgaagctctggtctatcttcagcacgtcgatgggaaactgcctgagataggccagattggaataaccggtgccgaaatcgtcgacggcgatggcgacgcccaagcgcttcagctcggccagcacgctcatggtttgggcgatattggccgccagcaccccttcggtgatttccagctccagcagttggggagcgatgccggtttcggccagcaccgcgcgcaccgtatcgctgaagcagccgtcggcgatctgcgcggccgagacattgacggcgatgcgcaagggcaagccggcgtcgtgccaacgcttgccgtccaggcaggcctggcgcaggatgaagcggcccagcggcaaaatcagcccggtttcctcggccagcgggatgaaatgtccgggagaaatgatttcgccgctctcatcgcgccagcgcatcaacgcctccaccccgacgatccgcccctccgtcacatccactttggcctggtagtaagcgcgaaaccctcccgactccgcgcccatgcggatatggcgctccagcgcctgccgcgacagcagcgcctcctcgatctcggccgagaaaaaacggtagcggttgcgcccgtcctccttggcctggtacatcgcggcgtcggcgtggcggtacagttcttcctggtcgcggctatcgtccgggtacagactgacgcctatgctgaccgacaggtcaaatcgttcctcgtccagcaggcaaggttcggacaccgccttctgcaagcgggcggcgacggcgcccagttgttcgatgctgaccggatccggcatcaggatgatgaactcgtcgccgccctgccggctgatggtgtcgccgggccgcactatcgcctgcaggcgcttggcgaccagctgcagcaagcggtcgccgaccgaatgcccgaccgagtcgttgatcaccttgaaatggtcgagatcgagaatgaacagccccagccgctcgccgctgctttctgcctggcgcagcgcctgctgggtgcggtcctgcagcagcatgcggttgggcagattggtcagcgcgtcatgctgcgccagatgcatcatcttgaccgccagcgcgcgcgcttcgccgacattgtggaacacgatgatggcgccggtcagctcgccggcatggtcgaggatgggcgcggcggaatcctccacctccaacagccggccatcgcggcgcagcagcgcccggtccagcgtcatgccgacggcgcggcgttcggccagcaccagccgcaccgggttgtcgacgccgcggccggcatcgctggcctgcagcggcatcacgctttcgatcggctggcccagcgcctctttcgccagccagccggtcatctcctccgcgatcgggttcaaaaacgtgacccggccggcggcgtcggtggcgatcaccgcgtcgcctatcgaattgagcgtgatgcggatgcgctccttttcatcccgcagcgccagctccgcgcgcttgcgctcggtgacgtcggcgatcagcatcaggcagccgggcctgccgccctcctgcggccggtgcgccagcgccacctggccatgcagcgtgccgccgtccggcttggccaggctgaggtcgaaagtcgccgcgtcgccgttcagcgccgcccgcagccgcagctccatcgccaggaagttggcctcccccagcaccgcccgtgccggcagaccgcgcatgtcggcggcggcgatgccgaaccaggcgccgctctcgtcgttggcgaactcgttgcacagatcggcgttccagtaggcgacgaaggccggcaaccgccgcagcacctcggccagatcccgctgcgcggccgccagttggcgggttcgcaaacgcagcgccagctgggtctgcacccgcgcgcgcgccaccggcacgttcagcggcttgtgcaggaaatcgacgccgccgatgttcagcgcctgcagctcgtggccgtcttcgtcatgcgaggtgacgaaaatcaccgggatgtcgctcagccgcggcgtggccttgatctcccggcataccgcgtagccatccatgccgggcatttcgatatcgagcaggatcacgtccggaaccgcccgctgcgccatttccaaggcctcgcggccgctggtggcgaagcgcacctcgcccagatcccgcaccgcctcgcggatgacatggatattgctcgccatatcgtcgacgatcagtatccgcgccctctcatgccttagatcgttgaacatccggcttccttatggcgcggctgcgccgatgcggcgacggcctgggcgcggctgcgcccggctcatgagttaggcatagccttcggccgccccggccacaagccggcaggatacggatgggatcaagattccagcgaaataatggtaagcacgtagcgctgcgcgcatgtttatgttgcagcgcaacaacttcagtgcgcgctgtccgctcccgccgccggcgcgcttggcgccggacgccggatgagcagcaacagcggcagcaccgccagcgacagccacatcatcacggtgaagtcgtcgatataggccaccatctccgcctgcctggtcacctccaggttgagcaaggcgcggccggcgtcggtgaacgggctgagcgccgccggcaactcccgcagcagcgggctgcccagcgccacatgctcgcccagcaccgcatgcgctcgcgcggcgtcctcggtcagcatggtctgcaccagcgagatgccgacgctgctgcccacattgcgcagcaggctgtagatcggcgtgccctcgttgcgcagctgcggctccagcgtggcgaaggtcaccatgctcaagggcacgaaggtgaagcccagcccggcgccctggatgaagcctgacaacacgatgatgccgctgcccatgttcggcgcgatgccggccatctggtacagcgacagcgccgtcagcagaaagccgccggccatgatcagccgcgggtcggccttgtgcaccagccgccccaccagcatcatcgccagcatggtgcccaccccgcgcggcgccatcacctcgccggtgaacaccaccgggtagtccagcaggctttgcagcaggctgggcagcagcgccatggtggcgtaaaggatcatccccaccacgaaaatgaacaggctgccggtgacgaaattgcggtcgcgcagcaggccgcggctaaggaaggactgcccttccggcgcggaccaggtgtggatgatgaaatagacgaaggccgccgcgcagacgatggcctccagacagatttcggcggagctgaaccagtccagctgctcgccgcggtccagaaacagctgcagcgcgccgatggccacgcacagcgtggccaagccgaaacggtccagcttgtcgttgccggcgcggctctccggcagatagcgggcgatgccgtaaaaggccagcacgcccaccggaaggttgatgtagaacacccagcgccagctggcgttgtcggtcagccagccgcccaagagcggcccgaggatggggcccaccatgatgccggcgccccagatcgccatcgcctgccccactttttccttgctgttgatgtcgagcagcaccgcctgcgacaagggcaccagcgccgcgccgaacaccccctgcagcaagcgcgcggcgacgatctgccacagcgaatcggccaggccgcacaaggccgaggcgacggtgaagccggccaccgacgccagcagcacccggcgccggccgaagcgcgcgcacagccagccggtcagcaaggtggcgatggcggcggcgacgatgtaggaagtcagcacccagctgatctggtcctgcgagctttgcaggctgccctgcatgtgcggcagcgccacattggcgatggtggtgtccagcgcctgcatgatggtggccagcatgatggccacggtgatcatgccgcggtgcggcgcgccgacggcggcgttcatcgggacagcaggctcgccagattgccgtgcaccttgcccagcagcgcgcgcagctgcgcgtcctcctccggactcaggccttgctgcgcctgttgctgcagctcgtcgcccagcgccatcgccgatttcaacgccgcgaaggccggctccagcagttcgatttcattgacccggcggtcggtcgcgctgggcacccgccgcagccagccggccgcctgcatccggtcgcacagcgtcgccacgcccatcggcgtcaggtccagcttgtctgccagttcggcctgcgacaagggcttttcgccctcgtgcgccgccagcgcgcccagcaagcggcactgcgccagcgacaagccgagctgctgccgcgccctttggtcgaaaacccggccgtacaaccgcccggtgtcgctgaccagaaagccgaagcgttccgcgatgcgtatcttcatgatgtcatatcgtatagtggtttattatttgcacaataccatagccgcggcgggagtccagcagcgccggccgcggccatgaaaaaggcccggacgcggacgtccgggccttgcgccttctcgcggcggcgctcacagttcccaatattccttttcccggccctgcgagcccggattcagctgctcgcgcaggcggcgcagcttttccggctcgccgcgcacgcggaagcggctgccctcgtcctcggcatgctcttccagcacctggcagtggctgtagatctcgccgcgcagctgctgcgccgaccacggcaacagcagttcttcctccaccaggtcttgctggaagaaggagacgatggccgcatgcaggccggccacgtcgtccgggcgcagcgcgctcatcaccacgcagcccgggtagcgctgccgcagttcggcggtccaggcggcctgcgccgcggcgtcgccgacgtggtctatcttgttgaacacgcggatgcgcggcacctcgtcggcgccgatctccttcagcaccacgtcggtcacttccagctggcgctcgaagccggggtcgctggcgtcgatcgcatgcagcagcagcgaggcgtccagcgcctcctccagcgtggacttgaacgaggccaccaggccgtggggcaggtttttgatgaagccgacagtgtcgctgaccaagacgcgcggcacgctttccgggtacagcacccgcaccgtggtgtccagggtggcgaacagcttgttggccaccagcacctcgctgccggtcagcgcccgcatcagcgtggacttgccggcgttggtgtagccgaccagcgacaccccgcccagcccctggccctgacgctccagccggcgcgcgcgctgggtcttgcgctccagctccatcgcggtgatttcgcgctgcagctcggcgatgcggtcgcgcaccttgcggcggtccagctcggtgtgcgattcgccggaaccgcggccgcccatgccgctgcgctgccggccttgcgggccggccagcttggccgcctcgcgcaggcgcggcgccatatagccgagacgggcgatttccacctgcgcccgcgccgcgcgcgagcgggcgttgcggtggaaaatctccagaatgaccatggtgcggtccatcacctcgcagccgacggccagctccaggttgcgcatctgcgacggcgagatttcatggtccaccagcaacgcgtctatctcgacggcgctggcgtccatctgctgcggctcgtcttccagctcgtcggcgcggatgccgcgtttgacgaacatgctgatttcttccagcttgcccacgcccatataggcggtgcggtcgaagctgttgcgcttttgcacaaaggtctgcaccacctggaaacccagggtcttggccaattcgctcaattcggtgagcgaggcctcgaactcgacatcgctgacttccggcagctgcaccgaggccacaatggcgtagcggggcttctctttgacttctgtttgcatctacggatggctttattttggatgaagagcccagatagtacccgcaaacggcgcgctccgctggccagtcgcgcatcttccttgaccggacggccggcgcggccgatactcgtgccgcttcgggctccgccctttatcttccacagccgtaatcattcatgtcattcgcttccctgggcctgcagcccgacctggtccagtccgctctcgagcaaggctatatccagcccaccgccatccagaacgccgccattccggccatcttgcaaggcggcgatgtgctggccaccgcgcaaaccggctccggcaaaaccgcggccttctgcctgccgttgttgcagcaatggctggccagcccgcgcgccgtgctgcgccagccgcgctcgctgatcctgctgcccacccgcgaactggcggcccaggtcggcgaaatcctgcgcgacctggcccaggccctgccccgcaagctgaaagtggcggtggtgtacggcggcgtgtcgatcaatccgcagatgatggcgctgcgcggcggcgccgacatcgtggtggccactccgggccgcctgctggatttgcatcaacataacgcgctgcggctgtcgtcggtcaaaaccctggtgctggacgaggccgaccgcctgctggaccaaggcttcgccgaagaattgaaccgcgtgctggccctgctgccggcgggccggcaaaacctgatgctgtccgccaccttcccgccggcggtatgctcgctggcgcaaacgctgctgaaccagcccttgcggatagacatcgaacaaaacgccgccaccgcgccggacatccgccagcgcgccatcgaagtggacgccgacaagcgcaccctgctgctgcgccatctgctggcgacgcatgactgggatcgggtcttggtattcgtcgccagccgccaggccgccgaccgggtggccggcaagctggcgcgcaacggcgtggccgccgccgcgctgcacggcgactgcagccagagccagcggggccaggcgctggccgacctgaaatccgggcgcttgcgggtgctggtggccacggacgtggcggcgcgcggcatcgacatcgcccggctgccgctggtggtgaactacgacctgccgcgctcgccggccgactacatccaccgcatcggccgcaccggccgcgccggcgccagcggcgaggccatcagcttcgtcagcgccgattgcgccgcccacttcaagctgatcgaaaaacgccagcaactgcggctgccgcgcgaacggatagacggcttcgaaccgagcgaggccgccgcgccagccgcctctctgacggacccggacggcaacggcggcatcaagggcaagcgcaaaagcaagaaggacaaattgcgcgaagccgccgcgcagcaaaccgcagccgaccgatgaaatgaaagaagccccgcgaggggcttcggctcaagggcatccggcggctggcgccgggagaatcagccttgctcgcgcggcaccgggccattgctgaaggcatagcttttcttgtcctggaaaatcaccagattgtacttgccccattgcgagcgcagcaccatgtggccctgggcgttgtattcgatatcgccaggcatgcccagaccgagaaccggcgcgataacccaggcgatatcgcggcgcggcagcgccccggcgctgaaatccttggccatttcgtccagcaattcgcgatatcccgccttgatatcgccgcgcagcgcctgcaaagcggccggatcctggctcgtcaacgcggaaaacggcagggcatcgcgcagcaagaccacgtattcgccgacccagggcttgctcttgccgtcttcctccacggtggactcggcgcgcaaatgcagttgaacctgaatgccaaccttctcgtcggcgacgaagtacatcaggtaaggcttcaacgccgccttgtccctaatgctgccggcgttgagcttgcccagctcgtcgccgatcgcagcgatggcttccgcccgcgcatccagctggtacaaagcggaagacttgccggattcgcccatatcctgggtcaggcggtcgatattcatcgaattggccaacacccccagcggtcccagcaatacccccaccgccacgctgcctcccgaagtttgccgcacaaaagcggaatgttcgggaatttcataggagcgggaatcgacttcatccttggtcggacgggcttggctcagcgccaccccattcgccgcgacagcggccggcactttcgccgccgggatactctgcaaactgccgcaggcgctcagcaacgccgccatggcgatgcccaaaacacaatgcaatcgtttcatcattcgttccattcatcacgggaaaataaaggcctctgacgggctctgaaaataccggcggcgcaaaaccaaacgccggacatgcaaaaagccccggcatgccggggctttttataatactggcggagagggggggattcgaacccccgttagggtattaccctaaacacgctttccaggcgtgcgacttaaaccactcatccacctctccgtgaggtgtactactcaaataaaaacccgcgcggcggattttcatgaaatctggcggagagggggggattcgaacccccgttagggtattaccctaaacacgctttccaggcgtgcgacttaaaccactcatccacctctccagaccctgtcgccgttgcgctttggcgtttcgccgacagaggctgcgcagtatataagtcctattcgtctggcgcaagcgttttataagcggaatgtgaaaaaagctcgtccacataatcgcccatgccttgcctttcgcgctccagccaggcggcgatcgcggcgcggaaacggccatcggcgatatagtgggcggaacaggtggccaccggctcgaaaccgcgcgccagcttatgctcgccctgggcgccgccttcgaaggcctccaccccctgggcgatcgcatattccaagccctggtagtagcacagttcgaaatgcaggcagggcacgtcgtccagcgcaccccagtagcggccgtacagcacatcgttctggcgcatgcacaggctggcggctatcggccggccgccgcggctggcgacgaacatcacgcaatggccggccagccgctcgcctatcagacggaagaaatccaggttcagatagggcgccgagccatgctccagataggtctgccggtagcagcggtagaacagccgccaatcggcgtcggagatctccgcgccggccaaggccctcacttcgacgccggcctccgccaccttgcgccgctcctggcggattttcttgcgcttgtcgcggctgagcgtggcgaggaaatcgtcgaaatcggcgtagccgcgattgcgccaatggaactgcacgccgtcgcgcagcagccaaccggcctgccgcagccggctggcctcgtccgcagtcggaaacagcacgtgggccgacgacaggccgttgtcgtccaccagttgccgcaggccggcgatcagatgcgcctgctcgtccgcgccgcccagcagccggccgccagtcaccggcgtgaatggcgaggccaccaccagcttcgggtaataatccagcccggaacgggcgtaagcctcggcccacgaccaatcgaacacgtattcgccgcggttgtgccgtttcaaataagccggcgccagcgccaccgcttggccgtcgcgctccagcgccagcggcatcggttgccagccggtggcgccgccgacacagccggtctcctccagcgccgtcagccatgcttggccgacgaacacgcccgcgccctctccctgcggccacgccggccgctttatggcggccacgccgtcatacagttgcagctgcaatgcttttcctttctgaaccgacgccatcttcaggtaaaatcggacgatcaagaatcatcggtgtcttctcaagatgcgtatcgcactcgcccagttcaaccccgtcgtcggcgacatcgccggcaatgccgaaaaaatcctgtccctggcccacgccgccatcgcccaaggcgccgacgtgctggtcacgccggaactggcgctgaccggctacagcccggaagacctgctgctgcgcgaaagcttctaccgcgaggtggccaagggcctggacgccatcgagcaactggacggcatcaccgtgatcgtcggccatccggcgcggataggcaatgagcgcttcaacgccgccaccgtgctgcgcgacggcaatcgcctgggccagtaccacaagatgcagctgcccaataacgaagtgttcgacgagtgccgctacttcaccccgggcgccgcgccgctggtgttcgagcagaacggcgtcaaggtgggcgtgctgatctgcgaggacatctggcatctggagcccgccgcggaaaccgccgacgccggcgccgagttgatcgtggcgctcaacgcctcgcccttccaccgcgacaagatcgaaacccgccagcaaatggcgcgcttccgcgtcgaggaaaccggcctgccgctggcctacgtgcagatggtgggcggccaggacgaactggtgttcgacggcgcctccttcgccgtcaacaaggatggcgaagtcgtcgcccaggccgcagcctacgacgaggagctgctgctggtcgactatgccgacggcgacttccagcccggcaagcaagccgcgctgccggacgcgctggaaagcgtgtaccgcacgctggtggtcggcgtgcgcgactacatagtcaaaaacggcttccccggcgcgctgctcggcctgtccggcggcatcgactcggcgctgacgctggcggtggcggtggatgcgctgggcgcggacaaggtgcacgcggtgatgatgccgtcgcgctacaccgccgacatttccgtggccgacagccgcgacatgatcgcccgcctgggcgtcaagtacgacgaaatcgagatctggccgatgtacgaaagcttcatggccgcgctggcgccgtcgttcgatggcctggcgatggacaccaccgaggagaacctgcaggcgcgcatccgcggcaccctgctgatggcgctgtccaacaagagcggcaagctggtgctgaccaccggcaacaagtcagaaatgaccaccggctactgcacgctgtacggcgacatggccggcggcttcgcggtgctgaaggacgtggccaagaccctggtgttcgagctctgccgctggcgcaacaacgtgtccgacgtgatcccggaacgcatcatcacccgcccgccgtcggccgagctgcgcccggaccagaaggaccaggacagcctgccgccgtacgagattctcgacgccatcatggcgcgctatgtagaaggcaaccagtcggccgccgacatcatcgccgccggcttcgccgaagcggacgtcaaccgcgtggtgcggctgttgaagatcaacgaatacaagcgccgccaggcgccggtgggcccgcgcgtcacccagcgcggcttcggcaaggactggcgctacccgatcaccaaccgcttcagctgaatccgcacccgggcggcgccatgccgcccgcctgcgcgccaagccgaaaacaggtcaagggcataacccttcccgcttcaggtacaatggcaagctgccctcggatcaccggactttcacaggaccctgaaaacaatgactcgcatcaaactggccgccgccgcggcgctttcctccctcgccctgctgaccggctgcgccacgccgctggccggcaagccggccgacgaggcaacccgcaaggtaatcgctcagaactggcaaaacgccagctacaatttcgacggacagctcggcttcacccagctgcgttttatcgacagcgaaggcaaactgagccagcccgacatcgccgacaccgtcgatcaggtcggccgctccatcaagatgaacatcagcggcgccatcgacgcgccgaccggccgactggagctgacaccggaactgcgcttcgagcgccgcaacctgctggccagcgtcaaggtgccgctgcagttccacgcccaggacatgtcgctgctggtggacccgtccgccatcgacctggccctgccctcgctgcgcaaaaaccccggcaaattcatccgcgccaaactgccggcagacatcgccgccaagatcccgctgaaggaaatgtaccaggcgatgccgcagattctcgaccaggcctacgcccaagtggacaagaaagccttcagcttcgagccgctggacgcctatgccgacgaggtcggcgccaagtacaagctgcgcctgaccctcagcaaggaacaggagcagaaaatgacgctgcagatcctggacggcctggccaaggccgcccatcagcaggctgcccaaccggatgacaagttcaacgccgaatccatgctcacgctggtgcgcgacctggtcaagctcagccccgccggcgaaatgaacggccagaccgtcagcgacatctatgtcagccgcggcggcgagcttgaagccatccgccagaccatccacatgaccagcgccgaattcagcgccgatgcctacttcaacctgcgctacagccatcatggcaagccgcagttcgtctaccagccggccgaaagcgacatcatcgactacgacaagctggagctgccggactggctgaagagcaaggccggcgccgacgaagcgcccgccgccgatgccgccctgcccgccccggcctacccgcagccggccgcgcccgccgccaaggccaagaagagaaaggccaaaccgcgcgcgcagtaatcgtcaaacgcccggccgtccggaacggctgggaagccagactgtcatacctgttttcccggcggccgcggccgcccgcaaggaccttacccgatgaaaccgctcaagctcgccctgaccgccgccgccctggcctgcctggccgtgccggcgcacgcctccgccatcgcccagctgaaggcttttgtcgccggcagcaagaccctcagcgccgacttcacccagctggtgaccaacaagggcaagcgcgaggaagccagcggccggctggaaatcgcccgtcccggcaaattccgctgggaatacagcaagccctactcgcagctgatcgtcggcgacggcaagacgctgtggatctacgaccaggacctggcccaggtgacgcgcaaggcccagggcgcggcgctgggctccagcccggcggcgctcttggccggcagcaacgccatcgagcgcgactaccggctgaacgaggccggcaagcagggcgatgtggagtggctgaccgccagccccaagaagcaggacaacaccttcagcagcgtgcgcatgggcttcaagggcaatatgctggtggaaatgcagctgaccgacagcttcggcaacgacacccgcgtcagcttcgtcaagccgcagcaaaacgtggtgcttccggccaaccgcttcgccttcgtcccgcccaagggcgtggatgtggtcagcggcgactgacccccgccgcgcaaaaaaagcccgccgtgccggcgggctttttttcgcgcctcacgccggcttgagcgcccaggtggcgatgaaggtcggcagatagcggtcgatcaggaagcgcggccgcggctgccagtcctcgtgaaaaccggcgatcagaaagcccgccgccgtctgcccgccgatcagctcgtccaggctgtggccgaacaccagcgcctcgcccctcgttcgcttcgcctccagctcggcctcggacaaatgctcgggatcggcgtatggaatggcgaatcgcggccggatcaggccctgctccatcagcgcaggatcgcggtcggcgacgaacaccgccgggttgtagaagctcgccagcaagcgtccgcccggtctcagcactcgatggcactcccgccacaccggcgctacatccggcacatacagattggagatcggatggaacacgcagtcgaagctcgcgtcggcgaagcgcgacagatcgcgcatatcgccctgctccagccggaacgccaggctctcgcgctcggccacctcgcggtcgcgcgccagctgctcaacggacgcgtccaataccgtcacccgcgcgccggcggcggcgagcagcggcgcctgctggccgccgcctccggccaggcacaagacgtccaggccgcgcgcgtcgtccagccagccggcgggcaaggggctgggcgtcagccgcgccagcacacggccccgccgggcttcggcgatggcggcggcatccaccggccgcgaccactcgcaatcggcgcgcgcctggcggtcccaggcggcctggttgtaatgaaaaacatcgtgttgttgaacggcatcaggcatcttgtcctccattgagggaagggaaagcaatgccgacgcgcgcgctgcgcgaaagcggcctcccatcagactcaagagacgggaaggattcggaacggattgtcgaaaacaagcaatgcgcacgctcgcacgcgccggacggcggaacgaatcggggatgcggaagcatccgggcatcacttgttcatttcgacaggactcctgaggatgaaagtcggggcgggaagggccgattctagcgaaacggccatgacaagagaatgcccgtttacacgccgcggcgctcgtacaccgcctgcgccagcgtgcccagatcgacatactccagctcgccgcccaccggcatgccgcgcgcgatgcgggtgacggccaggccgcgctccttgaacagctcgctgagcatgtgggacgtcacctcgccctcggcggtgaagttggtggcgatcacgatctcgctgacctggccgtccagcgcccgggtcagcagcttgtccagattcaggtctttcggcccgatattgtccagcggcgatatccgccccatcagcacgaaatacaggccctcgaaacacttggcctgctccagcatcatcaggtcggccggcatttccacgatgcacagctggtcctggcggcggccttcgtcggcgcagatggaacacagctcggcctcgctgaaggtattgcagcgctggcagtgggtcagctgggtcagcgcccggtccagcgcgcgcgccagcttgtcggcgcccttcttgtcgcgttgcagcaggtggaaagccatccgctgggcggttttgggaccgacgccgggcaggactttcagcgcggcaatcaaatgctccagcgcggggggattcttcatcgacacggcatcaacctgggggaaagcggccggggccgcacacggaaatcatttaatcagcgatagcgccggcgcagccggcgatggcgccaagcgaacaccagccgaaacagaagccggcacagcggcagcgtggcgggccagcgcggcaggaacgccacccggtccaccagctcgcagccatctgccgtggcggccacccggcggcggtgccaccagacgcgctgccccagcatgcgggagcgctcgtcgaaagcgcccggctccagccgcatcagcgtcagatcgtcgcactccaccggcaggcagccgaacagcagcagccagcaagagccgacgcggagcggcgcttccagccgcgcgggcagctcgcccgccgggagccgcatgccaagccaggggaagaattcgtcggcgatgccaccgcggctgacgacatcgcgccataccgtttccggcgggcgcggcagccggctgcgcatggtgaaatggccgaacatcccggctccggcaaaaaaggcccgtcgccgggcctgggggatcagaacggcagcttcatgccggccggcaggttcaggccgttggtgaagccggacatccgctcctgggtggtgctttccaccttgcgcgcggcgtcgttgaacgcggcggcgatcaggtcttccagcatttccttgtcatccagcacgctgtcgtcgatggcgacgcgcttgacgccatgggcgcaggtcatgacgaccttcaccatgccggcgccggactggccctcgacttccaccgtggccagctcgtcctgggccttcttcatgttttcctgcatttgctgggcctgcttcatcaggcccgcgattccagctttaccgaacattgctgttcactcctgtacgggttggatggtctcgatgagcagcgcggcgcccatttcgcgcaccagttgctgcaccaccggatcgtttttcatgcattctcgggcaatggccaattgctcctggcgctggcgggcgtcgaccatggccggggtttccatccccagttcctccaccgtcaccgtcagctccaccgcccggccgaagcgctcgctcaacgcggccttcagcttgtcctggtaatcgcgtccgctcatgtggcggaagctttccggcaccgccagctccagccgctgctggttccagcctttcaataccgcattgtgcgccagcattcgcgccgcgcccagcttgccgcccagatccaccaccagcgcctgccagtcgccgtcgaactggtagtcgaccggctcgtcgtccggcggcggcgcctgcgcgtagtcgggcatcgcgtcgccgtcatcggcctgccacggcgtgtcgtcgatttcgtcctcgtcgcggccatcatcgtccgcctcgcttgccgttgcgaccagctgcggttgcggcgccggagccggcgcggcgacaagcgcttcaggcgcgggcgcggcggccggcgcaggctgcggccggggcgcgggctcgggttccggctcggcggccgggacgctttcttcgctggccgcgcgcggcgcggacttggccggcgttggcgccgccaagccagccgcctgcagggcgcgcgccgccggcgacatgccccgctccgccggcaccgagacggaggctactgcggcggatgcggccgcgggcctggcctggggcgcgacagccgcacgagccggcgccgcggcttcggccggcgcgttgaccggatggaaagccagcatgcgcagcagcgtcatattgaagccggcatgctcgtccggcgccagcgccagatccttgcggccatggatggcgatctgataatacagctgcacgtcctgcggcgcgatggcgtcggccagcgcgaacaaggcctcgcgctccggctcgtcgtcggccagcgccgccggcaccgtctgcgccagcgccaactgctgcaacagcaccgccagttcggctagcgccgcgtcgaagctgacgccgcgctcggccagattgtccgcctccgccatcagcgccgcgccgtcgccggcggacagcgcctgcaacagggtgtacagatagcggcggtccaccgcgcccagcatggcgcgcacgccgtcttccttgacttcgcccaggccgtaggcgatggcctggtccagcagcgactgcgcgtcgcgcatcgagccggccgcggcgcggcccagcagcgccagcgccgccgtctcataggcgatgccttccacgtccagcatgtgcgccagatgcgtggacacctgctgcggcgtcatattgcgcagcgaaaactgcaggcagcgcgacagcaccgtcaccggcaccttctgcgggtcggtggtggccaggatgaacttgacgtgggccggcggctcttccagcgtcttcagcatcgcgttgaaggcgcttttcgacagcatgtgcacttcgtcgatgatgtagaccttgtaacggcccatggtcggcgcgtactgggcgttttccagcacttcgcggatgttgtcgatgccggtgttggacgcggcgtcgatctccagcaggtcgacgaagcggccgctgtcgatctggcggcaggccgagcattcgccgcaagggtcggcggtgctgccggtttcgcagttcaggcttttcgccagaatgcgggcgatggtggtcttgcctacgccccgggtgccggtcagcaggtaggcgtgatgcagccgcgcttccttgagggcgttgctgagggcgcgcaccacgtgttcctggccgaccaggtcggcgaaacgcttggggcgccattttctggcaaggacttgatagctcatgggggcggattttaatggcaattgccgcgcaaggcgactgattttaccggcgcggccaggcctggcgcgccggcgcttgcggccttactgggcggcggatgccggctccggcagtttccgcgccagcgcggcgtaatagcgttggcgcacctggtcggcgatttcctgcaccgccttggcgtacagcgtgctgcggttgtagcgggtgatcgcgtagaagttgttcagtcccagccagtattcggtgacgccgggcgagctttccaacgcgaacagcaccgccggcacgttgtccgccagcggcgtctgcggcgcgacgcccatcttgcgcaaatcgcccaccgtgtagtgcagattgaatttgtcggccagcaatttgtccacctgcggccccggcaccacgctggccggcgccaccacgtcgtcgccgcgcttccagccgaagcggctgaagtaatgggccacgctgccgatggcgtcgtgcgggttgttccagatgtcgcgatggccgctgccgtcgaaatccaccgcccacttgcggtagctggacggcatgaactgcggcagccccatcgcgccggcgtacgatcccctcagcgtcagcgggtctttgccctcttccttggccagcagcaggaactgggtcagctcgccgcggaagtaggcggcgcggcgcggataatcgaaaccgatggtggacagcgaatccaccagccggaagctgccggtgttgcggccgtagtgggtttccacgccgaggatggccacgatcacctcaggcggcacgccgtactggcgctcggcgcgcgccagcgcgtcggcattgtcctgccagaacgccgcgccgtcggcgatgactttgtcgctgacggtggaggcgcggaactggtaccagggacgcgaagtggacggtttgtccagaatgcggatgatattgggcttcaattcgacattggcgaacaccgcctccagctcggggcggttgaattggccgctggccacctgttcgtcgatatagcgctgcacgtccgggcgccccagaaaggcggcgtcggcttgggcctgcggcgcggagaaggccgcgccggccagggcggcggcaatagccagtttcaacatcgatttcatgattttgctttcttttatgagcgtaggcgcggttcattcgcggaaggacaaggcgctgcccaccaaccgcgcggtgatgtcgacgatggggatcaccctttcgtaagccatgcgggtgggcccgaccacccccagcgtgccgaccacctggccgttgacgcggtaaggggcggtgaccaccgagcattcgtccagcgtcaccaggccagactcctcgccgatgaaaatgttcacgccctgcgcctcgcggctttgcgacaacagcttcagcagttcggtcttacgttcgaacacgccgaacaactcgcgcagccgcgacaggtcgtcggacaggtcgttcacctgcagcaggcgcgagccgccgctgaccaccacgtcctcgccgctgctggccagcgttttctgtcccagccgcaccgcggccgacatcagctcggcgatgtcgccctgcagctggcgcaattccccctccacccgggaggtgaccgcgtccagcgcctggccgctgtaatgctggttgatgaaattgcccgcctccaccagttccgacggcgtgtagtcgcgctcggtcagcagcaggtggttctgcacgtcgccgtccagcgtcaccagtatcatcaggatgcggcgctcggacaggcgcaggaattcgatctggcggaaggcgacgtcgctgcgctgcggcgtcatcaccacgccggcgaagctggtcaattccgacagcagcgacgacgccgcctggacgatgcgctgcgggctgtccggctgcaggctggcctccagctcgtggcgcgccagctcgtccagcggccgtatcgtcagcaagcggtcgacgaacaggcggtagccgcgcgcggtgggcacccgtccggccgaggtgtgcggcgaggcgatcagccccatgccctccagttcggccagcacgttgcggatggacgccgaagacagctccatccccggcagcagcgacaaggccttggacgcgacaggctggccgtcggcgatgtagcgttcgatcaggaccttgagcaggcgttgggcgcgttcgttcatcatgttccccattgtacacatcctgaaccgcgccaaaagggccagcagcaagactttgcgccggttaggcgcttttgttccccggcaagctgctgttagggctctggttttctgcgataatcgccccattattggtccgacctaccccatttggagacagcatggcttccgaagacaagagcaaggcgctcgccgccgccctctcccagattgaaaagcagttcggcaagggttcgatcatgcgcatgagcgacaaccagatcaacgaaaacctgcaggtggtctccaccggctcgctgagtctggacttggcgcttggcgtcggcggcctgccgcgcggccgcgtggtggaaatctacggcccggagtcgtccggtaaaaccaccctgtgtctgcaagccgtggccgagatgcaaaaattgggcggcacctgcgcctacatcgacgccgaaaacgcgctggacccgcaatacgcgcaaaagctgggcgtcaaggtcgacgacctgctgatctcgcagccggacaccggcgaacaggcgctggaaatctgcgacatgctggtgcgctccagcggcgtcgatctgatcgtgatcgactcggtggccgccttggtgccgaaggctgaaatcgaaggcgaaatgggcgacagccacgtcggcctgcaagcccgcctgatgagccaggcgctgcgcaagctgaccggcaacatcaagcgcaccaacaccctggtgatcttcatcaaccagatccgcatgaagatcggcgtgatgttcggcaacccggaaaccaccaccggcggcaacgcgctgaagttctacgcctcggtgcgcctggacatccgccgcaccggcggcatcaagaagggcgaggaagtgatcggcaacgacacccgcgtcaaagtggtgaagaacaaggtgtccccgccgttccgccaggccgatttcgaaatcctgtacggcgaaggcatctcccgccagggcgaaatcatcgagctgggcgtcaagcacggcttcatcgacaagtccggcgcctggtacgcgtacaatggccagaagatcggccagggcaaggacaacacccgcgaatggctgaagtccaacccggcgatcgctgaggaaatcgaacgcaagatccgcgaagcggtgggcgtgaagatcgaaatcaacgaaaaccagggcgacgaagagttcgccgacgacgccctcgacgcctgatggcggcgacaggcaaaagcctgaaggcgcgggccgtcgaactgcttgcccgccgggaatattcccggcgcgagctggttcggcggctcgcgccttttgccgacagcgaagacgaattgaacgcggcgctggacgagctggccgccgccaactggcaatccgacgaccgcttcgcccgccagttcgccaacagcaagggcggcaagttcggcagccgtcggctgcagcaggaaatgcgccagcgcggcgtcgacgacgacaccatacgcgaggcgctgtccggccaggacgacctggccagcgcgcgcgagcaatggcgcaagaaattcggccgcccgcccgccgacgcggcggaaaaggccaggcagtaccgcttcctcgcccagcgcggttttcccggcgacgtgatccgccaggtgctggccggcggcgcggacgacgacggctacgaggactgaggcatgagggcgcgcgccatcgccaccgagatcgacatcaccgccgcccacgaaacggtgtggcaggtgctgtgcgactggccgcgctacccggaatggaatcctttcatcgtcggcctgcacggccgccatcggctgggcgcccgcctggtggccaccctgcgctatcccggcggcgcgcgcgccaccctgcgccccgtcgtcatcgaactctccgcgccgcaagcgctggcctggcgcagcgccgcgctgatgcccggcctgctggaccgcgaacaccgctggcggctggaagcgctggccggcggcgccacccgcctgcatcacgacggcgcgctcagcggagtgctgctgccgctgtgcggcgccggaatccaggaaagcgcgcgccggggattcctgctgatgaacgaggcgttgaaacagcgctgcgaaacccttgccagcgccgccacggcttgacacaatcgacggattcgccccgacggccagtccggggcaaaattttgaaatagaccagacaaaacatgaaaacctccgaaatccgcaagaagttcctggacttcttcgccgccaaaggccaccaggtcgtcccctccagcagcctgatccccggcaacgacccgacgctgatgttcaccgtcgccggcatggtgcagttcaaggacaccttcctcggcttcgagaaacgcgactacacccgcgccactaccagccagaaatgcctgcgcgcgggcggcaagcacaacgacctggaaaacgtcggctacaccgcgcgccaccacaccttcttcgaaatgctgggcaacttcagcttcggcgactacttcaagcgcgacgccatcaccttcgcctgggagttcctgaccggcgaacaatggctgaacctgcccaaagacaagctgatggtcaccgtctacgcctccgacgacgaggcctacgacatctggcacaagaccgtcggcgtgccggccgacaagatcgtccgcatcggcgacaacaagggcgcgccgtacgcttccgacaacttctggaccatgggcgacaccggcccctgtggcccgtgcaccgaaatcttctacgaccacggcccgtcggtcgccggcggccctccgggcagcccggacgaggacggcgaccgcttcatggagatctggaacaacgtcttcatgcagttcaaccgcgacgaagccggcacgctgcacccgctgccgaagccgtcggtcgacaccggcatgggcctggagcgcctgtccaccgtgctgcagcacgtgaagtccaactatgaaaccgacgcgctggcctgtctggtgcgcgccgccgcccgcgaaaccggcgtcgcctacagccaggacgtgccgtcgctgaaagtgatcgccgatcacatccgcgcctgctcgttcatgatcgccgacggcatcctgccgtccaacgaaggccgcggctacgtgttgcgccgcatcgcccgccgcgcgatccgccacggctacaagctgggccagaaaggcctgttcttccacaagatcgtcgccgacctggtggccgagatgggcgaagcctatccggaactgcgcgaaaagcaggcgcatatcgaagacgcgctgcgcgccgaggaaatcaagttcgccgaaacgctggaaatcggcatgggcctggtggactccgcgctggaaggcggcaagaaagcgctggacggcgacaccatcttcaagctgtacgacaccttcggcttcccggtggacctgaccgccgacatctgccgcgaacgcggcatccacgccgacctggaaggcttcgagcgcgcgatggaggcccagcgcgagcgcggccgcgccggctccaacttcaagatgaccggcaaaatcgcctacagcggcgccggcaccgccttccacggctacgacaagagcagcgtggaagcaaaaatcctggcgctgtacaagggcaccgaagcggtggacagcctgtccgccggcgacgaaggcatcgtggtgctggacggcaccgccttctatgccgaaggcggcggccaggtgggcgacgtgggcaagatttccgccaccgccggcctggacgcgctgttcgacgtggccgacacccagaagatccagtccgcggccttcggccacaagggccggctgctcagcggcgcgctgaaggtgggcgacgccgtcaccgccaccatcgacctgcatgcccgcctcgccagcgcgcgcaaccactcggccacccacctgctgcacgcggcgctgcgccatgtgctaggcagccacgttgcgcagaagggctcgctggtcaacccggagcgcacccgcttcgacttcgcccacggcgaagccgtgacggccgaacagatcgccgagctggaacgcgtggtcaaccgcgtgatctgccacaacgtggaagtgaaggccgagctgatgagcatggaagacgcgcagaaatccggcgcgatgatgctgttcggcgagaaatacggcgatgaagtgcgcgtgctgaccatgggcgatttctccgccgaactgtgcggcggcacccacgtcaagcgcaccggcgacatcggcctgttcaagatcgtcgccgaaagcggcgtggccgccggcgtgcgccgcatcgaagccgtcaccggcgaaggcgcggtagcccacgtgcaggcgcaggacgccctgctgaaggatgccgccggcgcgctgaaggcgcagaccagcgacgaagtggtggccaagatcgccgcgctgcaggatggcgccaaggcgctggagaaggagctggccaagctgaagggccaactggccgcctccgccggcgacagcctggccgacagcgccgccgtggtgagcggcgtcaaggtgctggccgcagagctggaaggcgcagacaacaccgcgctgcgcgaaacgctggacaagctgaaggacaagctgggctccgccgccatcgtgctggccgccaagggcgacggcaaggtggcgctggtggccggcgtcaccgccgacctgaccggcaaactcaaggccggggagctggtcaacttcgtcgcccagcaagtgggcggcaagggcggcggccgcccggacatggcccaggccggcggcacgcagccggaaaacctggccgccgcgctgaagggcgtggaagcctgggtagccggcaagctgtaaagccaaacgcacctgtaccaacggccacatgttattcatgtggccgtttttcatatggtaataatcaattttcacaatgtcggcacaccctagactaggagcatgccatgtccgccatagaactccgccaggccagctgggatgacctgcccgcggtatgccagctgatccagcaggccttcgcgccgctgctgacgcagctgccaagcccgccgaccgcgctggatgaaaccgtcgccagcctcaccggccacctcagcagcggcagccagatcttcgtcgccgtcaggcaatcgcgcatcgtcgcctgcctgctggtgctgccgccggaaaacggctgcgccgaaatcaagcgcgtctgcacccatcccgacctgcaaggccagggcctgggcgcggcgctgctcgattacgccgagcaagagctgcaacgccagggcgtgcagcagctcaagctatccacccgcagacgcctgcccagcaatctgcagttctaccagcggctgggctacgaggtcagcgcgcagcaaccgtatccgcagggcatagacgacgaacgcgtcacgctgagcaagccgctggcggagctggtgtgctgaagcgcggcgcaagcttgtcccagatcaatacgcaataaatcattcattactaatatacagaggcttcttatggcttctcctttgttgtttgcttgatgcccccggctcgtccggggcatttttttgcccggcgcgcgcggcggaatgcttatagtgggattacgcaccggataccggagagcatcatgcgcctgctccgcgccgccttcctcgcttgctgcctgcaagcgctgcccgcctgcgccgacctgccccagccagacatctacgcgctgaccgaaatcctgccgccgctcagctacggcgagggcggcgagcacaagggcttctccaacgaattgctggcgatgatgctgcgcgacagcggcctgcgcgccgtcatccaagtcaagccctggagccgcgcgctgcgcgaggcgcagcaagcgcccaacaccatgctgtatctggccgtgcgcacgccggagcgggaagagatgttaaatggataggcccggcgctgccgctgccgatagaactgttccggctgagcgggccgcgggccgcgcagcccgcctccatagacgacgccaggcatgcgatggtggcggtggcgcgcgacacgccgggacagaaaatgatggagaagctgggcttcgtcgacaatgtcaatctggtgctgaccaatgacgaggcccagtcggccaggctgctgtacgcccgtcgcgtgcaatacagcgtcggggtcggcttgttccagcgttacgccgccaagcagcagaaccagcagccggacaggctggattcggtgcaggtgctggacgacagcacccagttctatttcgcgatgcagagggacagcaatcccgactacatcgcccggctgcaggccgcgctggacaggatcaagcaggatgggcgctacgcggctttgctaaggcgctacacccacccctgactcacaacaccagcttgccgccggccagcgccagcatcaccgccagcgtcggccgcagccaatggtcggccagcctgccggtcaagcggctgcccagccagatgccgggcaacgagccgctgagcagcttgagcagcagcacccagtccaggtggcccatgccggcatggcccaggcccgccaccagcgtcagcggcaccgcgtgggcgatttcggtgccgatcagccgcgaagtcggcaaagccgggtacagcagaaacaaggccagcgtgcccagcgccccggcgccgatggagctgagcgtgaccagcacacccagcaccgcgccgaccagcgcggtcggccacagccgctcgcctacgcccaggctgccgaaatggcgctgccccaggcggaccagccacggcttgcataggatggcggcggcagtcagcagcaaggcgatgcccagcacgaaacggaacagcgcgtccatcacctgcgacggcacgtgcagccagctcaacaggcccaacgtcagcatcgccgccggcacgctgcccagcgccaggtgcagcgtgatgcgccagtcgatgtggcgctgccggtgatgcgcagccacgccgccagccttggtcagcgcggcgtacaagagatctgtgccgacggcggtggcaggcgagatgccgaaccaaagcagaatgggcgtcatcagcgagcctccgcccactccggtcagcccgacgatgaagcccaccgccaggcccgcaaccgtatatcccaaatccatcggattccccattcatcctgcaagatccatccgatgctacgcgctttgcttataacaatttagattaattagatacaacattataaacattaattccaagctctccctgcgcgccaagattcatcgcgccatcacggcgccgtaacaagggcggcctatgtttgcaatcagaacaaaacgacaaggaacgccacaatccctcgcggatattcacgcaatcgctttacaaaccggatgaatagcgtcaatttgatactgtcagggcacagcctgaccgcttgcgacgcccgcatggagcgccagccgccaggccccctgagaagcccacgtttcgagatcgaaaggtgcaggatgatttctcgtatccccctgagcgttcgtagaaaacaagcccgtgaccaacatgaaagcttcctctacgcggtggcgaaaccgcaactgagcgatgaggagagatcccgccagcaaaaagtgcggcaacgcgcgcatgaccgcgacgacgcccgcttcctggctgatcgctgcgacgacctgttctgacccgatgggggccgcgcccccgccctctgccttctccgctccgcccaaggcaagcgcccgctgttttttctttatgcccgctttgggctgaccaaaccgccgaatgcccgttcggccagagcgccgaactcatccccattccgccggtctacctaaaaaaaattgaaacattccgccttgcgcggcggcatttttcaaaaaaactggcatccgacagtatttttatactttctttacacccccactcccgcttttatcaggtttttgacgtccgtttgcgtaccttccaggttgcacattacgcatggagattttcactatggatcttctttacatcggtctgttcgcgctgttcggcgcgttgacctggctgttgatcgcagcctgcgaccaattgggaggcaagcaatgactgcctggtacctgatcagcgccctgttggcgctgggtctgttcgtttatctgatctacgcattggtcaagccggagaatttctaatcatgacaacacccgccatgctccaactggggctgttcctggccgtgcttctggcgctggcctggcctcttggcgcgtacatgacgcgcatcatgcagggggagaacgttggtccggtactctggttcgcgccgctggaacgcggcttctaccggctggccggcattcagaaggatgaggagatgggctggcgcggctataccgtggccctgatcctattcaacgtgctgggcgcgctggccgtctacgcgctgcaacgtctgcaaggctctctgccgttcaacccgcaggcgatggccgcggtcagcccggactcctcgttcaacaccgccgtttccttcgtcaccaacaccaactggcaaggctacggcggcgaaaccacgatgagctacctgacccagatgctgggtctgaccgtgcagaacttcctgtccgccgccaccggcgccgcggtggtgatcgcgctgatccgcggcttcgtccgccacagcagcgccaagatcggcaacttctgggtggatatcacccgcctgacgctgtacatcctgctgccgctgtcgctggtgttcgcgctggtgttcacccagcaaggcgccatccagaacctggccgcctacaaggacgtgcacacgctggaagtcaccaagtaccagcaacccaaggtcgacgccaagggcaacccggtgaccggcaaggacggcaagccggtgatggaggacaagactgcgcagacgcaaactctgccgatgggtccggtggcctctcaggaagccatcaagatgctgggcaccaacggcggcggcttcttcaacgccaactccgcccacccgtttgaaaacccgacgccgctggccaacttcctgcaggacatcgccatcttcctgatcccggccgcgctgtgcttcctgttcggccgcatggtgggcgaccgtcgccagggctgggccatcatcgccgcgatgaccatcctgttcgccaccgcggtggtcgtggaaaccagcgccgagcaggccggcgtgccgcaatacaaggcgctgcacatcgaccagcaagccagccacctgcagtccggcggcaatatggaaggcaaggaagcgcgcttcggcatcatcgacacctcactgttcatcgccgtgaccacctccgcctcctgcggcgcggtcaactcgatgcacgactcgctgaccccgatcggcggtctggtgccgatgttcctgatgcagttgggagaagtggtgttcggcggcgtgggttccggcctgtacggcatgctgatcttcgccatcctggcggtgttcatcgccggcctgatggtgggccgcaccccggaatacctgggcaagaagattgaaacctacgagatgaagatgaccgcgatcaccattctggtgaccccgaccctggtgctggcgctgaccgccatcgccgtgagcgtggccgcgggcaaggccggcatcgccaatccgggcgcgcacggcttcagcgaaatcctgtacgcgttcacttccgccgccaacaacaacggcagcgccttcgccggcctgtccgccaacacgccgttctacaacatcgccaccggcgtcgccatgttcttcggccgcttcttcatgatcgtgcccatcctggccatcgccggctcgctggccgccaagaagcgtctggccgtcaccgccggcaccctgcccacccacggcccgctgttcgtggtgctgctgatcggcaccgtgctgctggtgggcgccctcaactatgttccggctctggcgctgggcccggtggtcgagcagctgcaaatgctcgccgtccactaagcccgtcagtcaaggaaacgacaatgaacgacaagaatcatttgaaatccgtggtggcggaacctatcgccaccggcaacaagaacgccggcaagtcgatgttcgacccggcgctggtgaaacccgccatcgtcgattcgttcaagaagctgtcgccgcgcacccagtggcgcaacccggtgatgttcgtggtgtacgtgggcagcattctgaccaccgcgctgtggatacagtcgctgggcggccacggcgaagcctcgtccggcttcatcctgggcgtggcgctgtggctgtggttcaccgtgctgttcgccaacttcgccgaagcgctggccgagggccgcagcaaagcccaggcggcgagcctcaggtcggccaagaaaaacgtggtggccaagaagctggcaggcggcaaccatggcgcggccaagaccatcgtcgacggcaccagcctgcgcaagggcgatttcgtattggtggaagccggcgacgtgatcccggtggacggcgaggtgatcgaaggcgtggcctcggtcgacgaatccgccatcaccggcgaatcagcgccggtgatccgcgaatcgggcggcgatttctcctcggtcaccggcggcacccgcgtgctgtccgactggatcgtggtgaagatcaccgtcaatccgggcgaaaccttcctcgaccgcatgatcgcgatggtggaaggcgccaagcgccagaagaccccgaacgagatcgcgctgaccatcttgctggtggcgctgaccatcgtgttcctgatcgtgaccgtcaccctgctgccgttctctctgttcagcgtggacgcggtcaaggccggcaccccgatcagcatcaccaccctggtggcgctgctggtgtgcctgattccgaccaccatcggcggcctgctgtcggccatcggcgtggccggcatgagccggatgatgggcgccaacgtgatcgccacctccggccgcgcggtggaagccgccggcgacgtcgacgtgctgctgctggacaagaccggcaccatcaccctgggcaaccgccaggcctccgccttcatcccggcgccgggcgtgtcggaaaaagacctggccgacgcagcccaactggcctccctggccgacgaaacgccggaaggccgctccatcgtggtgctggccaagcagaagttcaatctgcgcgagcgccagctggccagccatgaagccagcttcatcgccttcagcgcgcaaacgcggatgtcgggcatcgactacgacggccgccagatccgcaagggcgccatcgacgcgatccgccgccacatcgccgaactgggcggccagttcccggacgcgctggcgaaaagcgccgacgaagtggcccgccgcggctccaccccgctcttggtggccgaaggcaaccgcgcgctgggcgtgatcgaactgaaggacatcgtcaagggcggcatcaaggagcgattcgccgaactgcgccagatgggcatcaagacggtgatgatcaccggcgacaacccgctgaccgcggccgccatcgccgccgaagccggcgtcgacgacttcctggcggaagccacgccggaagccaagctgaagctgatccgcagccatcaggccgaaggcaagctggtggcgatgaccggcgacggcaccaacgacgcccccgcgctggcccaggccgacgtggcggtggcgatgaacaccggcacccaggcggccaaggaagccggcaatatggtggacctggactccaatccgaccaagctgatcgagatcgtcgaaatcggcaagcagatgctgatgacgcggggttcgctgaccaccttctccatcgccaacgacgtggccaagtatttcgccatcatcccggcggcgttcgccagcacctacccgcagctgaacgcgctgaacgtgatgggcctgaacagcccggcctccgccatcatgtcggcggtgatcttcaacgcggtcatcatcgtgttcctgatcccgctggcgctgaagggcgtgaagtaccacgccaagagcgccgccgagctgctgcgcggcaacctgctggtctacggcctgggcggcctgctggtgcccttcgccggcatcaagctgatcgacatggcgctgggcgcgctgggtctggtgtaacaggcaagcccgcctcccggcgcgccggggagcgggcgcacggcaggcccggcgcacggaacgcgcaacgggcctctcgccaagagaatggaaaggattatcgtgaaagtcattcgtcccctgctggtgatcttcggcggcctgtcgctgctcaccggcctcgcctacccgctggccaccaccggcatcgcccaggcgctgttcccggcgcaagccaacggcagcctgatcgagaaagacggcaaagtggtgggttcgcgcctgatcggccagaacttcaccggcgacaagtatttctggggccgcccgtcggccaccagcccgatgccgtacaacgccggcaactccggcggctccaacctgggccccaccaacaaggcccagctggacgcggtgaaaggcaatgtcgacgccatccgcaaggcgcacccgacccagaccggcccggtgccggtggacctggtgaccgcctccgccagcggcctcgacccggaaatctcggtcgcctccgcctattaccaggttgaccgcgtcgccgcggcgcgtaaactgccggcaaccgaagtgcgcaagctggtggaaggccgcatcatcggcgaaaccttcggcctgctgggcgaaccgcgcatcaacgtgctggagctgaacctggcgctggacgaactttccaagaaagcctaaacccgcatgaccgatctgcgccccgacccggatgccctgctggacgaattgaaacgcgaagagctggacgcccagcgcggccggctgaaaatcttcttcggcgcctgcgccggcgtaggcaagacctacgcgatgctggcggcggcgaaaaccaagcagcaggaaggggtcggcgtgctggtcggcgtggtggaaacccacggccgcaaggaaaccgaggcgcagctggccgggctggaggtgcttccgcccagccagatcgagtacaagggccgcgcgctgtcggaattcgacatcgacacggccctctcgcgccgcccgcagttgatcctgatcgacgagttcgcccactccaacgtccccggctcgcgccatcccaagcgctggcaggacgtggaggagctgctcgccgccggcatcgacgtctacaccactctcaatgtgcagcatctggagagccttaacgatgttgtcggccagatcaccggcatcatcgtcagggaaacgctgcccgaccatgtgttcgacagggccgacgaagtctcgctggtggacctgccgccggacgagctgctgtcccgcctcgccgccggcaaggtctacctgccgcaccaggccgagcgcgcggtcaagaatttcttccgcaagggcaatctgctggcgctgcgcgaactggcgctcaggcgcaccgccgaccgcgtcgacgcgcagatgcgcgcctaccgcgccgaccagtcgatcaacccagtctggcacgcgcgcgaacggctgctggtctgcgtcggccccggcccgggcaccgacaagctgatccgcagcaccaagcggctggccgccaatctggacgccgactggatcgctgtctatgtcgaaacccccagcctgcagcggctgccggaggaaaagcgcgcgcgcatcctcaagggcctgaagctggcgcaagagctgggcgcggaaaccacggtgctgggcggcagctcgctggccgccaccctgctggcctacgcccgcacccgcaacgtctccaagctggtggtcggcaagtcggccagcagcccgctggcgcggctgtggcgcggctcgctggtggaggagcttacccgtcagtccggcgacgtcgacgtctacgtggtggcccacgacctggacccgtccgacgaaaagagcggcaagcgcgtgcccagcctgctgttcagcgacggcgaatccggcaagccgcagcgcggctacctggccgccgccgcggtctgcgccgccaccaccgcgctcaaccacttgctggtgccctacttcgcgctgtccaacgtcatcatggtgcacctgctggcggtggtgctgatcgccacccgctacggccgcggccccggcgtgctggcgtccttcctgtcggtggcggccttcgatttcttcttcgtgccgccgcagctgtcgttcgcggtgtccgacacccagtacctgctcaccttcatcgtgatgctggtggtggcgctggtgatcagccagctgaccgcccgcttccgcttcgaggccaccatcgccacctaccgcgagcgccgcacccgcgcgctgtacgacctgggccgcgagctggccggcgcgctgaccgcgtcgcagatcatcgacaccgcggtcggccggctggagccgctgttccgcgccaaggtgatgctgttcatccccaatagcgaagaccagctgcgcgccgccaccgaggccggcaacggcgccgacaccggcgtcgcgcaatgggtgttcgacaacctgcagccggccggcctgggcaccaacacgctgccgtccaacgccgcgctctacgtgccgctgaaggcgccgatgcgcacccgcggcgtgatcgcgctgctgccggaggaaacgatcccggccttcctgccggagcagcagcggctcttggaaacctgcgccgcgcagatcgcgctggcgctggagcgggtgcattatgtggaagtggcgcaagacgccatcgtggcgatggagtcggaacggctgcgcaacagcgtgctgtcggtggtgtcgcacgatctgcgcacgccgctgaccaccatgctgggcctggccaatatgctgaattcgcccagcctgccgccggagcagcaggccgacatctcgcagtcgatccaggatgaggcgatgcggatgaacaagctggtgaccaatctgctggacatggccaggctgcaatccggcgtcaagttgaacaaggaatggcaactgctggacgaggtggtgggcagcgcggtacgcgcctgcgagcacagcctgcgccgccatcatttggcgctaaaactgaaccgcgacctgccggtgctggaatacgacgcggtgctgatcgagcgggtgctggtcaacctgctggaaaacgccgccaaatacacgccggccggctcgcgcatcgagctggcggcccagcacgacggcgcccgggtgcgcatcagcgtcagcgacgacggccccggcctgccggccaatatggaacagaaagcctttgagaaattctcgcgcggcgcgccggaatccaccacgcccggcgtcgggctggggctggccatctgccgcgccatcatcgaaaaccacggcggcagcatagaagccggcaacctcagcccgcacggcgcccgcttctccttcaccctgcccgccggcgcgccgcccgagctgccgccggaagacgcctgaaaccagaagagcgaacccctatgaacgacgcaccgatttccgtagtgatcatcgaagatgaaaaaccgatccgccgcttcctgtcgtcggcgctggatgaggaaaggctcaccgtctacgaggccgaaaccggcaagcagggccagatagaagtggccacccgcaaacccgacatggtgatactggacctgggcctgccggacatgaacggcatcgacgtgatcaagagcctgcgcgagtggaccgacattcccatcctggtgctgtcggcccgcacccaggaaacggaaaaggtggcggcgctggacgccggcgccgacgactacctgaccaagcccttcggcgtggccgaatgcctggcgcgcatccgcgtgctgctgcggcgccgcatccagggcagcgccgcgccgcagcagaacttccacttcggcgacatcaagatcgacctggtcaaccgcctggtgcacaagggcgatgcgccggtgcacctgacgccgatcgaataccggctgttgtccacgctgatccgcaacgccggcaaagtcatcacccaccgcgagctgctgctggcggtatgggggccgtcgttctccgagcacaaccagtacctgcgcgtctacatgggccacctgcggcaaaagctggaagacaacccggcgatgccgcgccacatcgtcaccgaaaccggcgtcggctaccggctggtggaaagcgaccccagccgcaaccagaccgcctgagcgcggcggccagggttgacagccccctgccagcggcatattctgatgttcatgcgccgatttgacacagcttgcgggcgcgatacaaatgccagctaaagcgtatacggtgaacccgcttgcgctcctgatgtaaagtggccagcgggttttttcatggctgcgacacagccttggcgccgtaccgctctcccccgcaagccgtctgatcgacgcgggacgcgccgccatccggcggtcgtccaggcgccgagttaatgacaacttgcagggcgccgagaaatcctgctaaagcgtcgccgacggccacccgcccggcacgcgcagcgcgaccgaccttgggagagccgtatgtacgattgccagcaagacagctatgccgatttttcttttgcgatttacgacgccgtgggaagacctcgccccctctgtggcagcctgagcgccacaccgctgccgtccagcgacgacagcgccctttacgatctcgccgccttcgcccgcgaacagggctacagcctcgatcaccatgaacagcatctcaccgtgcacgacatcagccttgccgacgcgctggcgatcaacacccgcttcggagaaacgctgatcatcagctgcgatctgcgccgcgatccgccggtgcgcttctagtcggtacgcacgcagacagtaagcgggcgcgccggctataatgtgctgtttcgcacccatgccggcaggatttgatgctgtttgaactcaaccacgcctcgcgctcggagattctgcgcgaagggcgccagatcgcccgcctggctctgccgatgatggtggcccagatcgcccaggtggccaccggcttcgtcgacaccgtaatggccggccgcgtcggcaccgacgatctggccgcggtttcgctcggcgccagcgtgttcatcaccgtctacgtgacgctgatgggcgtggtggccgcgctcaatcccatcctgtcgcaccatctgggttccggcgacgcgcgcggcttcggccgcgacgccggccagggcctgtggttcggcctgctgctgggcacgctgggcggcgcgctgatgatcgcgctggaacccgcgctgcgccagtggctgcacctgccgcaggaagtgatagccaaggtgatgctgttcatcaccggcgccgccgtcggcatgccggcggcgatggcccaccgcgcgctgcacgcctacgcgtccagcctgggccaccccaaggccatcatggtggtcagcctgatcgcgctggccctgaacattccgctcaactacatcctgatccacggcttgttcggcttcccccgcatgggcggcgccggctgcggctgggccaccggcgcggtgttctggttcaactgcctggccttgctaggctacgtgagctggcataagaaattcgccggcaaccgcatcctcgccggcatcgcccgccccgactggcgccgcttcgccgcctttttgaaactgggcctgcccatcggcctgtccttcttcgtcgaagtcagcctgttttccttcatcgcgctgctgatcgccgagctaggcaccgtcgtcgtcgccacccaccagtcggtgctgaatttctccagcctgatctacatgctgccgcagagcgtggccaccgcgctgtcggtgcgggtcggccaccacgccggcgccggcgattaccaggccgcgcgcttcatttccggcgtcggcctgctgatggggctggcgatggcgggcatggccatggtgctggtgctgctgctgcgcgcgcccatcatgtggatgtacagcgccgacccgcgcgtgatatcgatgggcaccacgctgctcttgttcgccgccgtctaccagctgaccgacgccgcgcagaccatcgcctccggcgcgctgcgcggctacaaagtgaccgccgtgccgatgctgatccacatcacctcgttctgggtggtgggcctgggactgggcatcctgctgggattgaccgaccatatcgtgccgcggatgggcatttacggcttctggaccgcgctggtgatcagcctcaccgtggccggcctgctgctaacctattatctggcccgcgccagccgccgccggctgcgccgcgaccaaggaatcctgctatgagcctgcagtttagcgccgactacgatctgcgcccgcacaacaccttcggcctggccgcccgcgccgcgcacttctgccggctggacgacctggccgacctgtccgcgctgctggcgcatccgctttaccgccagggcccggtgctgtggctgggcggcggcagcaacctgctgctgacccgcgactaccccggcctggtggtgaaagtggcgctgaccggcattcgcctgctggaacagaacggcgacgatgtgctggtcgaggccgccgccggcgaaaactggcacgacttcgtgctgcacacgctggcgcaaggctggtacggcctggaaaacctcagcctgattcccggcaccgtaggcgcctgtccggtgcagaacatcggtgcctacggcgtcgaggtgaaggaccatctgcaagaagtggcgtgcgcgcagctggagcgcggcggcgaagcgctgacgctgtccaacgccgactgccgcttcggctaccgcgacagcgtgttcaagcatgaagccgccggcaagctgctggtgaccgcggcgcgcttccgcctctcccgcgcggcgcggccgcgcaccggctacggcgacatcctgcagcagctggagcggcaaggcatcagcgcgccgacgccgctggacgtcagccgcgccgtcatcgccatccgccagagcaagctgcccgacccggcggcgctgggcaacgccggcagcttcttcaagaacccggtggtatcgctgacccgcgccgaggcgttgttggccgaacacccgcagctgccgcactaccccgcgccggacggccaggtgaagctggccgccggctggctgatagaccaatgcgggctgaagggctatcgcgatggcgacgccggcgtgcatgagaaacaggcgctggtgctggtcaactacggccaggcgcgaggcagcgaaatcgaggccttggcccgcaaggtgcaggacaccgtggcgcagcgcttcggcgtcaggctggagccggagcccttgatactctgaggccggccgggaaccatgccgcgccggcgccactcaagctagcaacacgtatccgtgaaccacgcaatggagagcaggacgcaatgagcaagaaaccgactgtgctggtgttcgatctgggcggcgtgctggtcgactggaacggcatcgatccgctgatccgcctgtccggcggccgcctcagccgcgaagaggccaggctgttctggatgcatttccactggacggaaaagctggatctgggcgcatgcacgccgctggaattcagcgccgccatggcggacgagctgcggctcgacctgtcggccgaggcgatgcaggcccagttgcgcagctggaaccgcggcgccttccccggcgcgcgggcgctgctggaaaagctgtccgccgactggcagctggcggcgctcagcaatatcaacagcctgcactggcagcaggtgagcgaggaattccagctgctggacctgttcggccacaccttcgcctcgttccagctgcgcctgcgcaagccgcagccggaaatctaccgccacgtgcagcagacgctggggctggcgccggcggacatcgccttcttcgacgacaacatcgaatgcgtggcggccgcccgcgccgaaggctggcaggcattccacaccataggcttcgacagcctgcagcgcacgctgcgcgagcaaggctggctgtaaggcttcgggcggagcggcccgcgctccgccgccggcctcagcccagcacgccgctggcgcgcaggaacaggtacagcgccgccagcaagcctatcagccaggacaacgaacgcagcgaggccttgtccgccagatacagcaagccatgcgtcgcccgcgccaggatgaacacggcggcggcggcgttcatcgccgcctccggcaccttcatcagccaggccgcgaccaccgcggcggtccaggtcggcagcgcctcccaggcattttgctgcgcccagccggcgcgctgccggtagccgctggcccgcgccgcctcctcgcgcggccggtgattgtcgtacttcaccccggccttggcgacgccggcccagatcagcggcagcagcgccgccaacaacagactccacaatacgaacggcatggcgatcctccctcaacgattgcccggcttgtcgccgagataacggccgtcatcgaacgtcgccacccactgcggtttgtaaacaatcagcaccgccagcagcagcccggtcgtgaaggcctccgaccacgacagcagaaaatagtaaggcacggcgtcgtccagcagcgtctcccacggatacgcccccgccgccgccaaggccgccatgccgcacagggcggcagcgaacaggctggcgccggcggccaggaagccgttgacgaacacatagacaaagaaatgcggcggcaggaaacggcgcgccagggccagagccgacgccgccacgcccaccgccggcaacgcggtcagcagccagttcaagcccagcgcccgccagtcggcgtggccgccggccgctagcgccgcctgcaccgcggccagggccagcagcgccagccgcggccccatcagcaaggcgaacagggcgccgcccagcagatggaaggacaggccgggcagcaggccggcgcgcaacagccacagcgccaggtccagcacgcaggcgcccatccaggcgttgagcgcgccgtgctccagctcgcgccagcgcaccccggcgccggcccaggccagggccgccagcgccagcgcattggccagcccgagcggccacgcgccaaactgcaaagccgatagatccatgacgatacacttgcgatcagactgccttcagcataacagagccgccggacaaactggcgcgcttcgtcgccgcaaagccctcccttttgccgcgcgggccggtacaatacgcttttggatggagacccgcatgcccgccctacccgctcagcacctgattgcccagcaagttggccaagccctggccgaagacatcggccaatgcgattggaccgcccgcctgatagacgcggacaagaccggcgcggcgcgggtgatcgcgcgcgaggacgcggtgatctgcggccaggcctggttcgatgaatgcttccgccaggtggacagccgctgcgctgtgcaatggcgggtggccgaaggcgagtcggtcgccgccggcagcgaactgtgccgtatctccggcccggcgcgcgcgctgctcaccgccgagcgcagcgcgctcaacttcctgcagctgctgtccgccgtcgccaccgagacccgccgctacgtcgaggccgcggccggccaccgcgcccgcatcctggacacccgcaaaaccgttcccggcctgcgtctggcgcagaaatacgcggtgaccgccggcggcggccacaatcagcgcgtcggcctgttcgacggcatcctgatcaaggaaaaccacatcatggcggccggcggcgtggccgaagcgatgcggcaggcgctgcaagacctgccgcccggcgtgacgctgcaaatcgaagtcgagacgctggcgcaactggaggacgcgttggagaacggcgccaagctggtgctgctggacaatatgtcgctggagcagatgcgcgccgccgtcgccctgagcgccggccgcgcccagctggaagcctcgggcggcatcgacctggacagcgtgcgcgccatcgcggccaccggcgtcgaccgcatctcggtcggcaagctgaccaaggacatccgcgccgtcgacctgtccatgcgcttcaccctgtaagcgactacgcagcggcggcgttagctgtcatactgaagggatgccttccacaagccaagcatacgtctgccgccgcccatggacctgaccccgcgcaaacacggctcacgctccgcccgccatgccaagtggggggcggcgctgtttctgctggtcaccctcgggctggtgctgctcgatctcgccgtcagctaccgccaggtggaaaacgaggccgggcaccaggccagcggcctgagccagctgctggcggaacgactcagctccggcatccacgaagccgggctgatcctgcaaagcagcaaccagattccggaagtccaacacctgctgcgcagcggcggccaaagccccgaggcgcagcagaagctgcaacagaagctgcagcagcaattgcagctggcgccttacctcagccaaatcgagatcgtcgacaccgcctgccagaccatcttcagcagcagccgcagcagcctgccgcgctcgcgccacaacgaattctgccgctggctgcaccgcatcgacccgcaggaaagcaattacaccgccgtcacgcacagccccaccgagggcggcatcgtgctggccaacaagctgcacgacggcgacggcaacctgataggcatggccaccggcctgatcaaccacaacttcttccaggacgaggtcagccggctgacggtgggcgagcatggcgaaatcctggtgctggaccagcgccagctcaccgtggcgcgctggccgcaggtagccgggcacgacccgcaaagctaccgcccgctgcaggcgcacatgatcctgtcgcacgacgccaaccagaccctgttcagcgcgccgtccagcttcgatggctcgatgcggctgtacagcatgcgccagaccggcaattatccgttccaggtggcggtgggcatctcgcggcaggacttcacccgctacgtctgggacaaggcctggctggccctgcccggctggctgttcgtcgccgcgctgaccttgctggcgctgcgcaagcacctgtccaatctgcgccagcaccagcagctgctgcgcggcagcgagagaatccgcgacagcgaggagcaggcccggctggtgctggacaccgcgccgctggcgctcttgctggtcaacccgcgcacctgccgcatccagcacgccaacgcgccggcgcgcgagctgctgcggctgccgccgcgcgcgccggacgaaagcgccagccacgaactgaacctgccgctgaagctgcagccggtcgagcaatggctggcggaaaacgaagacgtgatgcagcgcgaggtggagctggagctggaagaccaaagccggctgtgggcaatcgtctcgctgcagaaactgggccgcggcaaccacccgtcgtcgctgatcgcgctgtatgacatctcgggccgcaagctgctggagcagcaactgcacgagagcaatctgcagctggccgagatggcggtgaccgacccgctgacccgcctctacaatcgccgccacgccgacacggtgctgcgcgacgaaatcagccgctgcgaacgctatggccagaccatggcgatagcggtgttcgatatcgaccacttcaagaaattcaacgaccagcatggccatcaggccggcgacaacgtgttggtggcggtggccaacgccttgcgcgacaccacccgcaacaccgacatcaacgcccgcatcggcggagaggaattcatggtgatcttcccctacacccgcctgcgcgacgcccagaaagtgatgagccgcatgcagatggcgctgacccgctccaccgtgtcggtggtcgagcaaccgatcaccttcagcggcggcatcaccgactggcgacccggcgacacgccgtcgcagatggcgtcgcgcgccgacaagctgctgtacgaggccaagctggcgggccgcaacatcatcctgtgcgaccaggaaacgccctgaaacgccgtcgctaggcgccgccggccgccagcgcgtcggccagcatccacatcatcgccgcggtggcgccccaaatggtgtagcgctgccactcgaaggacaggtagcgcccggcgatgccgtcgcggacatagtcgtgccggctgtaagcggcgcgatccagcaacaggcgcagcggcacctcgaacacctcggccacctcgtccggcgccggtgccaatgccagcggcggcgtcagcatccccaccaccggcgtcaccacgtagccggtgatggtgacgtagtcgggcagccgccccaacacccgcacgccggccgggtccagcccggtttcctcgctcgcctcgcgcaaggcggcgtccagcgtcgagcggtcgccgctctccaccttgccgccgggaaagctcacctggcccggatggctggacagatgttcggtgcggcgggtgaacagcaccgtcgcgccatcgtcgtgccacaccagcggcagcagcaccgccgccggccgcaattccggccccgccggccggcaaggcagatccgccaccttgccggtgaaatcataggactcaagccgccgggcaatcagcgcggcggcagcgtctgcctccatcgaccacatatcgttatccttttaccgcccgcgcccgcccagcgtcggcaaggtcatttcatttcggtgcgccaacaggcgcagcgccagtccggaccagaacagcgcctgcaacgacgcgacgctgacccagcccagccggtcggccagaaacaatccggcggccgccagtatcgacaccgtgccatagaaatcccgatgcagaatgaagggcacttcattgaccatcatgtcccgcaccacgccgccgcccaccgcggtgacgaaacccaacgacaccacgccgaaggcgttcaggccgaacagcagccccacctgggcgccggccaggctgaaggccaccagccccagcgaatcggcgacgatgaacagccgctccagcgtgcggctcttgcgccggtgcaggccggccagccaggcgatccataccgcgccggcgatgatgaacaggttggtgtaatcgtagaacaccagcggcacccgtccgaccagcaggtcgcggatcacgccgccgccgatagccgtcaccagcgccacgatggaaacgccgagcaggtccagccgcttgcgtatccccaccaggtagccggaaaaggcgaaagccgcggtgccgatcgccgaaaaccactccatctggaaaaaccggccgctccattccatgcctcaatgtaccaaaaaaaatgccagaccggcatggtctggcatgttttgcgactacggcgctcagcggcgcatcgagtcgaagaaggcctggttggacttggtggccttgatcttgtcctgcaggaactccatcgcctccaggtcgtccatcgggtacagcagcttgcgcagcacccagatgcgttgcagctggtcctgcgggatcagcagctcttcgcggcgggtgccggagcggttgatgttcatcgccgggaagatgcgcttttccgccatcttgcggtccaggtggatttcgcagttgccggtgcccttgaattcttcgtagatcacatcatccatgcggctgccggtgtcgatcagcgcggtggcgatgatggtcaggctgccgccctcttccacattgcgcgcggcgccgaagaagcgcttcgggcgttgcagcgcgttggcgtccacgccgccggtcagcaccttgccggaagccggcaccacggtgttgtaggcgcgggccaggcgggtgacggagtccagcaggatcaccacgtccttcttgtgctcgaccaggcgcttggccttctcgatcaccatttccgccacttgcacgtggcgggtggccggctcgtcgaaggtggaggacaccacttcgccgcgcaccgagcgttgcatttccgtcacttcttccggacgctcgtcgatcagcagcacgatcagcaccgcgtccggatggttggcggtgatggcgtgggcgatatgctgcagcatcaccgtcttgccggacttcggcggcgccaccaacagcgcgcgctggccgcggccgatcggcgcgatcaggtcgatgatgcggccggtgatgttttcctcggcacggatgtcgcgctcgagtttgaattgttcggtggggaatagcggagtgaggttctcaaacaggatcttgtgtttggaattctccggcgcctcgccgtttaccttgtccaccttcaccagcgcgaaatagcgctcgccgtccttcggggtgcggatctcgccctcgatggagtcgccggtatgcagattgaagcggcggatctgcgacgggctgacgtagatgtcgtccggccccgccagatacgaagtatccggactgcgcaggaaaccgaaaccgtccggcaacacctccagcgtaccctcgccgaaaatgctctcgcctttcttggcctggtttttcaaaagcgcgaaaatcagatcctgcttgcgcagccggctggccccgtcaatctcgttggaaatggccatttcaacgagttcggatacgtgaagatgtttgagatcagataagtgcatagcggtcgtgaggtcgactcggtaacaattaggcggaacgctaatttgagggtgtggaagcggaaacgaaacgggcggcctgaattttatgccacccgtcttgaagattgtgcgtggagaatagacgctttagatgttgctgtcaacgaaggccgtcagctggctcttggtgagcgcgccgaccttggtggacaccacttggccgcccttgaagatcatcagggtggggatgccgcggatgccgaatttcggcggcgtggcctggttttggtcgatgtcgagcttggcgactttcaggcggccttcgtactccttggagacttcgtccaggatcggggcgatcatcttgcacggaccgcaccattccgcccagtagtcaaccagcaccggcagatcggactgcagcacttcctgttcaaaagagttatcgcttacatggtggatgagatcgctcatgatttcctcgctaatggattcaagcctgcttaattcccgatggtaacaagcggcggcggccgcggcaaccggtcaaaccgcggcgaaaatccccgctcgccaaggggctttgcgcgccgctgcggcctccgggtccgcgccgcctcccactcggcaagtgctgaaaacggccatcattcggtataatgccccactgtttatatgagaaggactccaaatgggctttctgcaaggcaagaaaatcctgatcaccggcatgatctccaaccgctcgatcgcctacggcattgcccaagcctgtcaccggcaaggagccgagctggcgttcacctacgtggtggacaaactggaggaccgcgtccgcgaaatggcggccgacttcggctccaagctggtgttccgctgcgacgtgcagaatgacgacgaaatcaaccagctcttcgtcgagctggccaaggagtgggacggcctggacggcctggtgcactcgatcggcttcgccccgcgcgaggcgctggaaggcgatttcctggattcgctcagccgcgaagcgttccagatcgcccacgacgtatcgtcctacagcttcccggcgctggccaaggccgcgcgcccgatgatgcagggccgcaaggcttcgctgctgaccctgtcctacctgggcgcggtgcgcgcgatcccgaactacaacgtgatgggcctggccaaggccagcctggaggcgtcggtgcgcttcatggccgccagcctgggcaaggaaggcatccgcgtcaacggcatctccgccggcccgatcaaaacgctggccgcttccggcatctccggcttctccaagctgctgaacatggcctccagtcaggcctgtctgcgccgcaacgtgaccactgaggaagtcggcaacgccgccgccttcatgctgtcggacctgtcgtccggcatcaccggcgaaatcacctacgtggacgccggctacagcatcaacgcactgaacgtgccggaataagcttcccgccaaccggcggatggcgatgcgaagcggggcaatcctggatcagggtttgccccgcttcgcattgcccgcggctcccgctcaatccgccagccgcccctgccgccactcccgcggcgtcaaaccgcattgcgccttgaacgcccgcgacagcgcggcctcgctgccataccccacctcgctcgcgatcatcttcaactgccggccccgcagcagcgcctgctgcgccagccggacgcgccaggcctgcagataagcgccgggcgtgctgcccaccacgtcgcggaacgcgccggcgaaaacgctgcgcgacattccggcaagctccgccagcgcctccaacggccacgcccgccccggctgcgcgtgcatcgccgccagcgccttgcgcagccggggatgggatagcccggccagcatgccgccctgtacctgccggctttccatcaactgccgcagcaccaggatcagcaccgcctcgaacagcctgtccaccaacgcgtggcggccgcagttggcgccgaacgcctcttcgaacagcagcgccagcacgctgtcggcgccggcgatggccgccagcggcaggcacaccatttccggcagcgccccgaggatggggttgtcagcgccgccgtcgaaactcagctccgcgcaagccagatcggcgccgcgcccggcgtccgcgacgaaacgcctggccaccggccgggggtagagcagcaggctgggcacgtccacccgcagcgcaggctggccggcgcgcatgatctccagcgcgccggagcggatcaggtgcaactggccgccctcgcccggcgcggcgaaatcggtgacgccgcacaaggctccggaatggaacatccgcgcgcgcaccggaaagtgattcaacaaagcctccagcctatcggtgcatgcgtcggccacattcatactccatatcaagttttcgatactttacgtgacttttagtactcaacccaagcgtaaagttcgttctgccaaccggcaccagccattcgccaacatgcaaaggagcaccccatgtcgatcgacaccatcctgtaccgcgcccacgccaccgtcgccggcggccgcgaaggccatgccgcctcttccgacggtgccctggacgtccagctgtccatgccgcgcgaactgggcggcgccggcggccccggcaccaatcccgaacagctgttcgccgccggctacgccgcctgcttcctcggctcgctgaaattcgtcgccaccagggagaaagtcgcgctgccagccgccgccagcatcgccgcctctgtcggcatcggcaccgtgcccaccggcttcgccatcgaggcggagttgctgatctcgctgcccggcctgccgccggaaaccgcgcaggcgctggtggaaaaggcccatgtggtctgcccctattcgcacgctacccgcaacaacctcgacgtgcgcctgcgcctcgcctgagccgcgcccatccccaagcggagaaccctcatgaaaaccaagctccatatcgtcgcggcgtcgctcgccgcgctttgcgccggctccgcgctggccgccggcagccccggagtggaacgccatacccaggcttttctcgaaaccctggcccaaggcggcggccagccgctggaaaccttgtcgccggccgaggcgcgcgatgcgctggcccgcgcgcaaaaaggcgccaaactggcgccggcggacgtcagcgagaaaatcatctccgtcgacggccagccgctgaagctcaccgtggtgcgcccggcaggcgtccgcggcgcgctgcccgccttcatgttcttccacggcggcggctggattctgggcgactaccccacccacgagcgcttcgtccgcgacctggtggccgactccggcgccgccgcggtcttcgtcaactacacgccgtcgccggaggcccgctacccggtggccatccgccaagcctacgccgccacccgatgggtggcggaacacggcgcggcaatccaggtggacggcaagcggctggcgctggccggcaacagcgtgggcggcaatatggcggcggcggtcgccctgatggccaaagccggcggcggcccggcattgcgcgcccaggtgctgttctggccggtggccgatgccgacttcgaagacgcctcgtatcgcgaattcgccgatggccacttcctgacccggaacatgatgaaatggttctgggacgcctacacgcccgacccgcggcagcgaagcgacatctatgcctccccgctgcgggcggcgccggcgcaactgcgcggattgccgccggcgctgatccagaccgcggaaaaggacgtgctgcgcgatgagggcgaggcctacgcccgccaactggacgccgccggcgtagacgtggtcgccacccgctacaacggcatgatccacgacttcggcctgctcaacgcgctgtccggcctgccggccacccgcgcggcgctgcaccaggccagcgaggagttgaaaatgcgcctgcgctgacaacccagcacgttggcattgcccggcggcgcgaagcggtgtatcactacatcgccgcgcgccggattttcccgccggccaaccctggaatggatcaccgacagacgacatgcccgacaacgaccatcagctggccgccgatatcgcggcccaggctgccgagctgctgaaccagctgcggcaaggcaacaccgccggcgacaaggcgctgggcgcgctgggcgacgccaaatccgacgcgttgatcgcgcatctgctgcgccaggccaggcccgatgacggcctgctgtcggaagagtcggcgcccgacgacgcccggctgcgcttgcgccgggtctgggtcatcgacccgctggacggcacccgtgaatacagcgagcgcgagcgcgatcgctccgactgggcggtgcatgtggcgctgaccgaagacggcctgcccaccgcctgcgcggtggccctgccggcgctgggccagctgttctccaccgccgcgccggcgctggccggcgcgccgccgggtccgatccggatcttggtcagccgcagccggccgccggccatcgccgagcgcgtggccgggatgctgggcgccgaactggcgccgatgggctcggccggcgccaaggcgatggcggtgctgcgcggcgaagcccacgcctatctgcacagcggcgggcaatacgagtgggactcctgcgcgccggtcggcgtggcgctggccgccggcctgcacgcgtcgcggctggacggcagcccctgccgctacaaccagcccgatcccttcatgcccgacctgctgatctgccggcgcgagctggcgccggcgctgctggacgccatcgcccgcgcccaggccgaatccgcctgagcgccgccgctcaggcgggcggcggcggatcagccgccagcagcttcttcaacgcctccatcgagtaatagaaagcctggtcgagctggtcgatcaggcaggcggccgccggcagatcgcctgcgcggcccagttgctccagcgtcgcgcacagcgccgccagctgcagcgcgccgacgctgctggcgctgttcttcagcgaatgggcggtgcggaacagctcgccgccgtccgctttcttcaccgcctcgtgcaccgccatatgaatgcccgggcactcctgcatccaggcctccagcatcctgggcagcagtccggcgcggatgtcgcgtatcgcctgcaacacctgcggctctatccactcgccgcccgccaccgaggcttcggccggcgcctcgctctccggcgcggcctctttgcccgccgcgcgcagccagcgcgccagcgtggcagccaattcccgctgcgtgaacggcttggctaggtaatcgtccatgcccgcctgcaggcaacgctccttgtcgcccaggccggcgttggcggtcagcgccacgatggccaggcgcgcgtcggcgccccgctccttgtcgcgtatcgcccgggtggtctgccagccgtccatcaccggcatctcgcagtccatcagcgccaggtcgaacttttcctcgcccagcagagccagcgcctcctgcccgttgctggccaccctgacgctgcagcccatgttctgcagcatcgcctgcgccatttcctggttgaccagattgtcctccaccagcagcacatggccgctcagcttgccgaacgcgcgctcctggcgctcctggcgcgccggcccgcggccggccggctgggcgtcgggctcgcgcgcctggatcagcgcgttgtacagctccgagcgccgcagcggcttggtcagtacttggcgcgccaggctggcggcgtccttcagttgctggaagtcatcggccgccgagctgaggatgatggcgggcggcatcgcctcgcccagccgctgccgcgcctgagacaggaacatcaacccgtccagctccggcatcatcatgtcggacaagaccaggtcgaactgctgctctcccttcgcttctgccagccggtccagcgccgccagcgggctttgcagcgcgcatacccggcaatgccaggccgtcagctgctgctccaggatttccagattggtggcgttgtcgtcgaccaccagcacccgcagccggctcagccgctcgaccggcggcggcggctgggtttgcgggccattgggcagggtcagccggaaatggaagcgggtgcccacgcccggctggctggccagctcgatgcggctgcccatcatggccatcagccgctgcgagatcaccagccccaggccggtgccgccgaagcggcgcgtagtggagctgtcggcctgagcgaagggctggaacagccggctctgctgctccggcgtgatgccgatgccggtatcctccacgctgacctggcagctggtttcccgctcgccgcgcccctccagcgccacccgcaccaccacttggccggcctgggtgaacttgatggcgttgccgatcagattggtcagcacctgtcccagccgcttgctgtcgcctatcacctccaccgccgacgccggctgcgcgcacaaaagctccagccccttgccgtaagccaccggggccagccgctccacgatctcctccaccaacaggctcaggcagaaaggctggcggtccagttcgaacttgccggcctcgatcttggaaaagtctaggatgtcgctgatgatgctgagcaggttttcgccggagcggtggaccacgttgacgtaatgccgctggcgctcgtccagccgggttttcaatagcaggtcggccatgccgatcacgccgttgagcggcgtgcggatctcatggctcatcaccgccagaaattcgctcttggcgcgattggccgcctcggaggcgtcgcgcgcctcggacagcgccaccgactggcgctgcagttcgcccagcgcctgctgcagctggccattggcctcttccagcgccaggcggcgtttttccagcgccgcctcgcggtcgtgcagggtttggtacatccgcacccggttcagcagcaggttgtcgtccagcggcttcatcaggtagtccaccgcgcccaggccatagccgcggccgatgaactcctcggccttgaagatggcggtgacgaagacgatgggaatgccccgcgtgcgttccgtcatctgcagatggctggcggtctcgaagccgtccatgccgggcatctgaacgtccagcaaaatcaggtcgacatcgcgctccagcgtgcgcagcagcgcgtcctcgcccgaccccgcctccagcacctcgcagccggacaggcgggacagcagcgcccgcagcgtcacccggttgctctcgttgtcgtccaccaccaggatggcaaaccgcttgctcatgcttccgcgctcctgccgatgcgatagatatggctgccgccgcggcagggctcgaagccctcctccagcgccagccggtgcaagccgtcctgcggccccagcgccagaaaaccctccgcgtgcagcgagcgggcgaagcggcgcagcacctggcgctgcagttcggcgtcgaaatagatcagcacattgcggcacagtatcagctggaattcattgaagatgccttcgtcggtcagcgaatggcggtggaacagaatgcgctggcgcagcctgtcgtccatggccaggtagcgcccgttgccggccagataggcgtcgaacagcctgggcccgccgctggcgaggtagtgctggcggttgagcgccagcggcgcgctgggaaacagcccgctcgctcccagctccagcagatagggattcaggtcggtggcgaacagatggctgcggtcgagcaggcccagctcgtccagcacgatggccagcgaatacgcctcctcgccggtggagcagccggccgaccacagcttgatcatcggaaagctggccagatagggcaggatctcctcgcgcagttgcttcaactgcgccgggtggcggaaaaaactggtgacgcccaccggcagctcggcgcacaaccgctcgaacagggcggcgtcgcacaagaccgcgcgctggaattcggcgaagccgcgcagattgaactgccccatcagattgacgatgcgccgcttcaggctttcgcgctggtaatggcggaaatcgtagccgtaatggctgaccagcgcctgcaggaacaattccagcagcgcgccgtcgggcctggcggcgtcgcccatcgccgccgcggccgccacgctggcgatggccggcagcttcatgaggaaatcgtaatggccggcgttgcgggcgttgtccggcatcactcgcgccggcgcgcattcgtcgccgtcctcgacgatgacgcaggaaccggcggcgcgcaaggcggcgcagccgtccacgccgtcgctgccgtagccgcacagcagcaccgccagcacgccgtcgccgtattcgccggccagcgattcgaacaacgcgtctatcgacggccgagcgaactggatctgccggtcgcgggtgaggtagaccaggccgtgcgccacccgcatgtggtggccgggcggcgccacatacagcgtgccggcttgcgccggcgtcagatgctgcggcatcagcacccggtattcggtgcgcgatttcagcagctgatccagcagattgatctggttttcctgcacatgctgggcgacgaacaccaccatatcggacaagggcagatgttcgacgatgtgcaggatgcgctccaggctgagcgccgatcccgccagcgccagcgcccgcagcggcggccgctccccggccgcgggcggctgggcggacacctgccgcaccggcagccccagccgcatcaggctgtgcgccagcagcgcgtggtaggcgacgatcttcagcttgccgcccgagtccagcctggccgccaacgccgcgatcaattccgcgggcagcaggtcggcgtcgtagaagcacagctccagcatgtcgtcggccgggccgcgcagcagctcctgcaaggccgcgcgctcgtcggcggcgtccagccggcccaggatcgccgcccggcacagttcgccttgatgctggagattgacgctcacgtcttgcgccccgcgcaccactgcgccgccttggccaccagcacgtcgtaatccaccggcttggacaggtagtcgtcggcgccggtagccagaatcttctcgcgctcggccggcaacgccttggcggtgatcgccaccaccgggatggcggccagggccgggtcggcgcggatggccgcgatcgcctggtagccgtccatttccggcatcatgatgtccatcagcaccaggtccaccggctgctgcggcagaaactccagcgcgcgccggccgttgaccgcggaaaacagcttggcgccgtgccgctccagcgcggcggtgatcacgaacagattgcgcgggtcgtcgtccaccaccaggatctgcctgccggacagcagcttgctgtcgccgcccgccgccggcgtcttgcgcgccgcgtgctgtctgggcacgtcctgcaaaaagcgctccacgttttccatcagccgctggccggcctgcggcgccttgacgatcacgcaatcggaataggcgcgcagcgccgcctcctcctcgtcgccgggatggctgtcggcgtaaaacaccagcgagatcgcggcgtcggcttcgcgcagcgccgccgccgtcaccagcgcgtcggccgccggcccggcgcccaagtcgatgatggccagctggcagggcttttgccgcaacagcgccggccagtcggcgtccggcgcggccgccacgatggcgccgccgtcgcggcccagcagcgactgcacctcgtcgccgcggatgccgccgttttccaccaccaggatgcgctcgccgcccttgctgcccaccgcgctgatcagcgtcgcctcggcggctgccagcaggtggtcggcggcgggcttgctcaagaagccgatggcgccctgctgcagcaaggcttcgtcgcggtcgcgcgcggaaacgatgtagaccggcaggctggacagcgccggccgggtcttgatttcatgcagcacctgcgcgccgtccatgtcgggcaggccgaggtccagcagaatgccgtgcggccggtactgtccggccagagccagcccatcggccccgttctgcgccagcagcgtcttgtagcccagccggcggttcatgccgaccagcatctggccgaacaccgggtcgtcgtctatcagcaggatgatgcggtcgccggggctcaccgcgccgcggtcgtcgcccggcgcgtccagccgcgggcgcggcgcggctgccggatggctggccgcgtggcccggctgcggctcggccgccgcgccggcctccggcaacagcacgatgaactcgctgccctcgcccggcgcgctcagcagctcgatggtgccgcccagcatctgggcgaagcgcaggctgatggtcaggccgaggccggtgccgccgaactcgcgcgaggtggagccgtcggcctgctggaaggcttcgaagatcacattgcgcttttcctcggggatgccgatgccggtgtcgcggacgctcagccggatcggcagcggctggtcgggatgatggctgaggcggaaggtgacgccgccctggcgggtgaacttgatggcgttggtcagcagattgcgcaggatttgcgacagcttgtcggggtcggacacgaagtgccgccgcagctcgtcctccactgtgaagctcaggcccttgtcccgcgccacgtgttcgaacatgccttgcaattccgagcacagatcgcggctgctcaccggcgacaggtgcacgtccatgcggccggcctccaccttggacaggtccagcacgtcgttgatcagccgcagcaggtcttcgccggagcggtggatcacctgcgcccacttcagcgcctcgccctccaccttgccgtcctcgtcgctgaccatcatcttggacagcaggatgatggagttgagcggcgtgcgcagctcgtgcgacatattggccaggaattccgatttgtactggctggcctggtccagctgcctggccttggcctcctgctgccgccgcgcctcgtccagctccaggttttgctgctccagctgctgctgcgactcctccatctgcgcgttggtctgctgcagctcctcggtctgctggcgcagcagctgctgcgcttcttccatctgagcattggtctgctgcatctcctcggcctgctgctgcagcaactgctgctgctcctccatcctggcgttgctctcgcgcagctgctcgctctgctgccgcatttccttttccgacgcttcgctggccgccagcagcttgcggatgtgcgcgcgctgctcggcgacgaacaggaaagacgccagcatgccgccgacattggccaggaactcctgctttttgtcgtcgaaacgctcgaagctggacagttctatcacgccgaccagctctttttcgtgcagcagcgggtaggtgtaggtaaagcgcggcgtctccagcagggtgccggtgacgatgggcgccacgtcttcattcgacacctcgaggatgatgggctttctctcgcgcgccacctgccccaccgcgccctcgcccagctggaagctggcgccgatgtggttgcgttcggtatacatataactgccgatcagcagcagcacctgttcagactcctggtacaggtagaacacgccgcggccggcgtccaggtagcggcctatcatgccgatggccgagtcggctagctgctcggtggtcaggtccccagtcagcgccgcggatatctggccatagccgtccttcagccagttgcggcgctcgtcctcgctgcgggcgccgcgcagcatccgtatcatctcgttgatggcgatgccgagcttgtcctggttcgacgccagctgcacctcctggctcaggtcgccctggccgatcgcgtaagcccggctggccagcctgtccagcgcgtcgaccagttcctgcaatctggccatcaggctgttgccgtcgccctcccgcagccggatgtccatgctcaggtcgccttcagccaagcgggaggcgatatcggccgcttcggtcggctcgccgcccagccggctgagaatggaacggctggtcagccagcccaacaaaccaatcgccagcaacatcgccgcgctgatgaccagcgtcagctgaatggcgccgcgcttggtctgcgccgcctcatcggaaaacttgcgggcgatcaccatgttgtagtcgatatggccgtctatcattttttgcagctggatggacagcgggtccagcgccagcagcatctgatgaacgttggcgacgctttgcgcgtcgttgccgcgaatggcgagaatgggctccagaacggactggaatttctgccacaccggtttttcccgctccagccaatccttgtcggtcgcgtcggcaaagcagctgcccccatcgcagccattggtttcataactgcggatggcgtcgctgacttgttcgcgggcggtttgcagccgctgctctatcttcagccgcaaagcccggtcctcgtcgtaatcgaggcggccgacctggatattgacttccagaaaagcgcgccgcagctcgcccaatactttcaagctgggcaccgcgttgatattgccgaaattggcgccgtcgtagactttctccagcaaatactgctccagcgcggtgagcatggccaatcccagcaaagcggtggccaccagcaaggccatattcttgccgacagtgagtttcatgcgagtctctccggataaggcctgcgcggcgccgcattcaattttgcagtttagacaatcagcgaaactactaaggctttaaaaaggaactagactggaggcaggctgttaagcggaatagcatgaacagggaggaagccgatgccggcgccaggcgacattctggtggttgacgacaccatgacaaccctgatgatgctcttggcgctattgtccaccgagggttatcaggcaagctccgcgcagagcggcgccgaggcgctggaactggtgcgcaagcatcctccggatttgatcctgctggatttcagcatgccggacatggatgggctgcaggtatgccgccagctcaaggccagctcccgcacccgcgacatccccatcctgttcctcagctccatcgccgacacccaggccaaggtggacggcttcgccgccggcgcggtggacttcatcggcaagccgttcgagcgcagcgagctgttggcgcgcgtcaacacccacctggacctcgcccggctgaaaaagcgcctgagcaagctggtggacgaaaaaaccgagtcgctgcggctgagcgagcagcgctttcgcgcgatgatcgaacaagcgccggaagccatcatggtgtacgacctggacagcagccgctacgtcgacgccaaccagcaggccgaggcgctgactggccggcagcagaaggacttgatcggcatgacgccggtgcagctgtattcgccggaacaaccggacggactgcctactgccgaaagcgtgcgcctgcacgccgccagggcgatgaaaggcgaggtgcaggttttcgagcgcgtcatcgcccggcccgatggcagcaacatgccctgcgaagtgcggctgagcaagctgcccagcgaaaccggccgcctgctgcgcgtcagctacatcgacatctcgccccgcgtcgccgcccaggagaagatcaaccgcctggcctatttcgacgcgctgaccggcctgctgagccagagcggcctgctggagaagctggacaatctgttcaacatccgccaggaagccaatctgcagggtttcgccatgctgttgatcgatctgggcgacttcaagtccatcaacgacgtctacggcaacagcgtcggcgacctgctgctgtgcgaagtggcggaacggctgcgccggctggccggcgccggcaatctgatctcgcggctggccggcatcgaattcgtggcggtgctcagcgggatccacagccgcgaaaaagcggaacaggcggccgacgaggcgctggaggccctgtcccgcccgttcatcatcgacgagatgacgctgaacatcaccgtcagcataggcgtcagcctgggtccggaacacggcgccagcggccaggaactgctgcgcaacgccgacatggcgctgtacaaggccaagcagcaaagcaagcgccgcgtccaggtgttcgaggcggccctcagccagcagatgcgggaacgggtggagctggaaaaggagctgcgccacgccatcgaggaaaaccagctggtgctgcactaccagccgcagatcgagctggccagcggccgggtggtgggcgtggaggcgctggtgcgctggcaacacccgcggaagggtatgatcccgccggcccagttcatcccgatcgccgaacagtccggcctgatcctgccgctgggacgctgggttctgcaggaagcctgccggcagctcagccgctggcaggccaaggagccaacccgcatccgcatggcggtgaacctgagcgtggcgcaattcaccgaccacgagctgccggaattcgtcgccggcatcctgaagcaaaccggcatcccgcccagcagcctggagctggaaatcaccgagtcctgcgcgatgttgtcgccgcagcagtcgatagacatgatgcggcaattccaccagatgggcgtgctcagttcgatagacgatttcggcaccggccattcgtcgctggcctacctcacccgcttcccgctggacacgcttaaaatagaccaatcgttcatccgcaatatttccagcgacgaacgcgacaccgccctgtgcgacaccatcgcctatctggcgcaccggatgggcctgcaggtggtggccgaaggcgtggaaaccgatgagcagctgaccttcctcaccagcatccacgtcgacgtggtgcaaggctatctgctgtgcaagccgctgccggcggcgcaggtggaagccttcatcctgcaaaggccggaccagtcgccgcggcccggcgtcgaatacttctagctcagcgcggcagacagtcgcggatgagcgccagatccagatgcttctccagcatgtcggccagcttgtcgatattggcctcgcgcagcgccggatagtccaacgcttccggctctttcagccccgcccagcgcaggatggcctggcaggcggccggttcgtccagcacgccgtgcagataggtggcgaagatctggccgtcttccgagcgcgcgccatccaccgagccatcgtcaaaccgaacggcgggatgcgccagggccggcccctggctcacccccatgtggatttcgtagccggcggcctcggcgtcgcccaatgtcagccggccgcgcatccgcgtcagccgcttctccggcgccagcgtggtttccatgtccagccagcccaggccgtcgccgctgcccggctcgccttccaatccatccggatcgtgcagcttcttgcccagcatctgcaggccgccgcaaatgcccagcaccttgccgccgtagcgcagatggcggcgtatcgcctcctcccagccttgggcgcgcagccaggcgaggtccgccagcacgctcttgctgccgggcagcacgatcaggtcggccggcggaatggtttcgcctgcgcgcaccagggtgaactccacttgcggatgcaggcgcagcggatcgaaatcggtgtgattgctgacgcgcggcgcggcgggcgcggccacgcgcagcttgtcgccgccgcccgatgcgccgccgagcttgtccagacccatgctgtcctcggcctccaggtgcaggtcgtacagatagggcagcacgcccagcaccggcttgccggtgtgctgctccagccagtcgacgccggtcttcagcaacgacggatcgccgcggaaacggttgatcaccaggccgaccacccgggcgcgctccgattcggacagcagcgccagcgtgccggccaggtgggcgaacacgccgccgcgctcgatgtcggccaccaggatcaccgggcagtccacagcctcggcgaagcccatattggcgatgtcgccgtcgcgcagattgatctcggccgggctgccggcgccttcggcgacgatgcattgatactgctcggccagccgcgcgtgcgactccagcaccgcctgcatcgcgatgggcttgtagccgtgatagccgcgcgcctccatattgccgatggcgcggccctggatgatcacctgcgagccggtgtggctgttgggcttgagcagcaccgggttcatgtcggtgtgcggctccacgcggcaggccagcgcctgcaccgcctgcgagcggccgatctcgccgccgtccgccgtcaccgcgctgttcagcgccatgttctgcggcttgaacggcgccacccgcacgccgcgccgggccagcaaacggcacaggccggtggccagcgcgctcttgccggcatcggacgtggcgccctggatcatgatggttttggcggtcatggcgatctccctgcgcatggatggctgacaacgcttagaatggcggcttgattcattccggccgcccaaagcgcgacagaattgcgcattggataatactgagcggcggccggccattatatagggctgttcgttgaattccgcactgtttctgccgatcgcgctgctgctggaccgtctgctgggcgagccgccgcgctggcatccgctggtcggcttcggccggctggtcaaagccatggagcggctggcctacccggccgcgccacaggctgagccggtctggcggatgcgcttgcgcggcgctgcagccatcgcgctgctgctgaccccgcccacgctgatcgcctgggggctggcgaggctgccgtggctgggcgccatcgttcccatcgccctgctgtatctggccgtcggcgctcggagcctggcccagcacgccgaagtggtgcgaaaagccttggccgacggcgacttggccctggcccgtgaacgggtgggctggatagtcagccgcgacaccagcgagctggatgaagccggcgtggcgcgcgcaaccatcgaatcggtgcttgagaacggcagcgacgccgtcttcgccgcgctgttctggtttctggttctgggcgcgcccggcgcggtgttgtatcggctgtccaacacgctggacgcgatgtggggctacaagaacgatcgctacctgcacttcggctgggccgccgcccgcttcgacgacgcgctgaactatctcccggcgcggctggccgccctaacctatctgctgctgggccatgccgccgacggctggcgctgctggcgcgcccaggcgcctacctggtacagccccaacgccggcccggtgatggcggccggcgccggcgcgctgggcgtcagcctgggcggcggcgcgcgctatcacggccaatggaaggaacgtccgccgctcggttgcggtcccacccccacgcatgaagacatcggccgcgcggtgcggctggtcaaccggggcatgtggctgtgggccgggctgtcgctggcggccgccatcttgatcggagcgatccatgcttgaacacggaggcggcctgctgcgcgccgcggccgaatacggcattccggccggcgactggctggacctgtccaccggcgtcaatcccaacggctggccggtgccgccgctgtcggccgacagctggctgcggctgccgcagaacggcgacggattggaagcggcggccgccgactattacggcagcgacaagctgctggccgtggccggctcccagccggccatccagttattgcccaggctgcgcgcgccctgccgcgtcggcatgctggcgctgtgctacgccgagcacccccaccactggcagaagcgcgggcaccagctgttccgcctgtcgccggatgagctggccgccggcatagaccaactggacgtggtgttgctgtgcaatcccaacaaccccaccggcgaccgcttcgatgcggcgctgctggaaagctggcggcagcggctggccgcgcgcggcggctggctggtggtggacgaggcgtttctggacgcggccccggaggacagcatgctgccgcacatcggcaagccgggactgatcgtgctgcgctcgatcggcaagttcttcggcctggccggcgcgcgcgccggattcgtcttcggctggccggagctgctccaggcgctggccgaggagctggggccatggacggtggccggcccagcgcgcgaggcggtgaagctggcgctgcgagatgtggaatggcagcgggacatggccagcaagctgcagcgcgacagctcaagactgcaacgctgcctggagcggcacggcctgccgccggccggcggctccgagctgtttcaatgggtgccggatgcgcacagcctggcgacgcaccgctacctggccggccgcggcatcctgacccgctacttcgaatccatccccagcctgcgcttcggcctgcccaaaaccgatcaggactgggtgcggctggaacaggcgctagcggactggaatcggttttaatcaaaactactgatgttcacagcccggtttttgtcacgtatcatccgattccatcatgacggtgcccctagagggtgaaacgggaacgcggtgaaaaaccgcggctgcccccgcaactgtaagcgcagagtccacgcctgacgccactggcccttagcaaggtcgggaaggcggcgcccggacggcgacgcgcgagccaggagaccggccgtcatacgtgtcgacgcaagcagaaaccgggcggggtgtaccgggggatacgcacaagctccgctcatggataagaagacggaaggatgtgccctcgcttgcgcgacgagtatcgtctacgagggcaccatgcatccatccaccacgctgtccacgggccgccgtctggcgcgccacgctcccatactcgccgggctgatcctggccaatctgttggcctgggcctgggccttcgccgctttcgccgaccacccggcccagctcgccaccgccctgctcgcctatttgttcggcctgcgccacgcggtggacgccgaccatatcgccgccatcgacaacaccgtgcgcaagttgatgcaggaaggccgccacccgtcggcggtgggcctgttcttctctgtcggccactccgcggtggtggtcatcgccgtggcgctgatcgtgttcgccgccagcgccttgcaaagccgcgtcaccggcttcaaggagataggcggcgtcatcggcaccagcgtgtcggccttcttcctgctggcgctggcgctgatcaatctgtcgtccttgcgcgcggtctgggcggctttccgccgcgcccgcgccggcgagcccatctgcgacgagcaactgaacctgctgctgaacaaccgcggcctgatcgcgcgcatgctgcgcccgctgttcaagatggtgaccaaaagctggcatatgttgcccatcggtttcctgttcggcctgggcttcgacaccgccaccgagatcggcctgttcgccatcgccacctcgcaaagcgccaacggcgtggcactgtggcacatcatggtgttcccggtgctgttcgccgccggcatggcgctggtggacacgctggacagcatgatgatggtggaagtgtacggctgggccttcatcaacccggtgcgcaagctctggtacaacctgaccatcaccttcgtctcggtcgtggtggcagtcggcatcggcgggctggaaggcctgggcctgctggtggacaagctgcagctcagcggcggcctgtgggatgtgattgccgccctcaacgacgacctggcccatttcggctatttcgtggtcggcgtgttcctgttcacctggctcgcttccgccgccatctacaaatggaagcgcttcgaccaaatggccccggaggcgcaatgagaacgcacgacaaacacgtgctgatgtgcaccggcccgcgctgcacccctgacggcgagggctcggaggcgatgttcctgcacctgggccgcacgatagacgcctgcgacggtctgcgcgccaagcgtacccgcagccactgcttcgccgtgtgcaaggaggggccggtgatggtggtgtacccggacggcgtctggtatcgcaaagtcagcgaagccgacgtcgagcgcatcgtctgccagcatctgaagggcggcgtcccggttgaagagctggtgttccataaaaccggcagcggcgacatcgaaacggaaccccaggcatgagcgccgaaatcgcactattgagccacgccggcaccgacctcgccgcgctgtcgcgcgcgcgctggcctgaggatttccccgcggtcaccggcatcgcgctgcaaggcataaccgacgaggccgcgatgcgggcgctgctggacggccagcttgccagcgcccgcgccatcgtgctgcgcgtgctgggccgcgccgacgcgatacccggcctggagcggctgctggcccacgcccgccggctgcaggccgcggtcatcgtggtcagcggcaccggcgagccggacccggagctgcaggcgctgtgcagcgcgccggtatcgctgcagcaggacgtccacgcctatctgcaggccggcggcagcgtcaacctgggcgagatgatgcgctgcctggccgacaggctgctgctgaccggctttggctaccagagcccgcagccgctgcccgagcacggcgtctaccacccggagctggccgcgccctgctcgctggaagattggctcgaaatccgccatccggactggcccaccgtcggcctgtgcttctaccgcgcccactggctgtccggcaacacccgcttcatcgatctgctggtggactgcttggccgagcgcggcgtcaacgcgctgccggtgttcacctcgtccttgcggaccatagaccagggcggcctgccggcggcgctgacgctgctagccgatccgcgcgcgaatgtttcgctgctgatcaacaccacctcgttcgcgatgggcgacatcaacaacgacggccccacccagcccggctgggcggtggaggcttcggaccaactggatctgccggtgctgcaagccatcaccagcagcatgacccgcgagcaatgggaagcgtccgaccgcggcttcaacccgctggacacagcgatgaacgtcgcgctgcctgaattcgacggccgcatcatcggcgtgccgctgagcttcaagcagccggccgaggccggccaggccgagcaatacgcgccgctgccggaccgcgcccgccgcctggccggcatcgccgcgcgcttggcgcggctgcgccatctggaaaatgccggcaagcgcatcgccttcatcttcaccaactccaacagcaaggcctcgcagataggcaacgcagtgggcctggattcgcccgcgtctctatacgctatgctgcgcggcatgcaaggccgcggctaccggatggatccgctgccgccggacagcgacgcgctgatgcacgagctgatagaccgcggcgcttacgaccaggactatctaagcgccgagcagatgaaaaacgccgccgcccgcgtgccggcccagcgctaccaggcctggttcgacgagctgcctgaggcgctgcgcgacaagatgctgcagcgctggggccagccgccgggcggcgcctacgtcgacggcgacgaactggtattctctggcctggattacggcaatgtcttcgtcgcgctgcagccgccgcgcggctacggcatggacccggacgccatctaccacacgccggacctgccgcccactcaccactactacgcgctgtaccgctggctgcgcgacgactggcgggccgacgccatcgtccacgtcggcaagcacggcacgctggaatggctgccgggcaagggcgtgggcctgtcgcagaattgcttcccggacgcgctgttgggcgacatgccgctgttctaccccttcatcgtcaacgatccgggcgaaggctcacaggccaagcgccgcggccacgcggtgatcatcgaccacctgacgccgacgatgaccaccgccgacagctacggcccgctggcgcagctgacccagctggtggatgagtactaccaggtggaactgctggacccgaacaagctgccgctgctgcagcagcagatctgggacctgatcaaggaggccaagctcgacaccgacctggccgcgatgctgaagcacgaccatgatcacgatcacgatcacgagcatcaccacgatcatgaccatagccacgaccacccgcatggcggacaccagcacgcgcccgccgccgtccacggcaagtaccgggcgcaggcggccaagccggcggccgcgatgaagccggcggcggccgcggcggcgaaataccgcccagccaaggccgcgcacagccacgatcatggacaccatcatcaccatcatggcgaccacgaccatcaccacggccaccatgaccaccatcatcatgatcatcacagccacgaccaccacgaccatgaccacgattgggacgacacgctgaacgaggacggcgtgcccttgagcctggccaagatggatggcgtggacgtcgcccacctgatcgaggacatagacggctatctgtgcgaactgggcgcggcgcagatccgcgacggcctgcacgtgctcggcaacgcgccgcagggcgaggcgctggtcgacatgctgctggcgctgacccggctgcccaatctgggcatccccggcctgcccgccagcgtggcggcggcctgcggcggcgactggccgctgtggcagcaggaccagggcaagcggctggccgaagcccccgcgtccttgcaagcgttggccggccaggcgctggtcacccgcgccgacgcccatgacgcggtgatgaagctggcgcgcgcgctgatcgccgatttggccgcgcgcggctaccacgccgccgccatcccggccgccgtcgaaaacatcctgcccggcatcgagccgcatgccgatctggagcgggtgctgaacttcgtctgcgccgaactgtgcctgaagctcgcccgcaccgccgaggagatagacaatctcttgcgcggcctggaaggcggctacgtgccggccggccccagcggcgcgccgacgcgcggcatggcccacattctgcccaccggccgcaatttctattcggtggacccacgcagcctgccctcgcaagccgcctggcgcataggcgacggcttggcgcgcgagatgctggcccgccatctgaaggaaaccggccagtatccggaatcggtcgccatcagcgtgtggggcaccagcgcgatgcgcacccatggcgacgacatcgccgaaatcctgtcgctgctcggcgtcaagccgcgctggcagcaggaaagccgccgcgtgcaggggctggaagtgatccccttggccgagctgggccggccgcgcatcgacgtcaccgtgcgcatcagcggcttcttccgcgacgccttcccccacctgattgcgctggtggacgaggcggtgcacaccgtggcgcggctggacgagccggcggagcagaacttcctgcgcaagcactacctggccgacctgaagaacgaactcttaggcaagctgcccgactccgacgcgcagtcgctgtaccgcgtgttcggcgccaaaccgggcagctacggcgccggcatcctgccgctgatcaacgagcagaactggcagaacgacgccgatttcgccaccgcctatgtcaactggggcggctacgcctacggccgcgcggccaacggcgccgacgcccgcgacgcgctgcgccatcggctggcgggcgtggaagtcgccctgcacaaccaggacaaccgcgaacacgacatcttcgacagcgacgactacctgcaataccacggcgggatgatcgcgacgatacgcagcctcagcggccgccagccgcgcgccttcttcggcgacagccacaatccggaagcgccagccgtgcgcggtctgaaagaggaagtgctgcgggtgttccgctcgcgggtggccaacccgaagtggatagccggcatccagaagcacggctacaagggcgcgctggagctgaccgccaccgtcgattacctgttcggctacgacgccaccgcccaggtggtggacgactgggtctatgaacaactggcgcaaagctacgcgctggacccggcgatgcagcagttcttcgccgacagcaacccgtgggcgctgaacgccatcaccgaccgcctgctggaagccgcgcagcgccaactgtgggcggagccggacccggacacgctggccgccctgcgccagctgcacctggatagcgaagcgctgctggaagcgcgcggagaaaacaaagcatgagcccgatttaccccttcgccgccatcgtcggccaggaacaactgaagcaggcgctgctgatctgcgccgtcgacccgacggtcggcggcgtgctggtgcgcggcgacaagggcagcgccaagagcaccgccgcgcgcggcctggccgccgtgctgccggcgatacgccgggcgaccggctgcggctacaactgcgagcccgaccatccgctgccgctgtgcccggtgtgctccggcgacgcgcgcgcgctgcatgacggcccggtgcccttcatcaacctgccgctgggcgccaccgaggaccgcgtgctgggcagcctggacttcgaaaaggcgctgcagggcggcaagcaggcgttcaagcccggcctgttggcggcggcccaccgcggcatgctctacatcgacgaagtgaacctgctggccgaccacctggtcgacgtgctgctggacgccgccgcgatgggcgtcaacaccgtcgagcgcgagggcctggcggtcagccacccggcgcgggtgacgttgcttggcaccatgaaccaggaagaaggcgatttgcggccgcagttgctggaccgcttcggcctgatggtggacgtggccgcgccgcgcgagcccgccctgcgcgccgaggtggtgcgccgccgcctggccttcgaggccgacccagccggcttcgccgcccaatggcaaaccgacagcgaagcgctgcgcgccaacatcgccgccgcgcgcgcgctgctgccgcaaacccggctcagcgatagcctgttccacttcgtcagcgagctgtgctgcgaattcgacgtcagcagcctgcgcgccgacatcgtgctgaacaaggccgcccgcgcgctggccgcgctggacggccgcgccgacgccagcgccgaagacatccgcgacgccgcccggctggtgctgccgcaccgccgccgccgcaaaccgttcgagcaaagcgggctggaccaggacaagctggagcagatgacgcggcaggcgtccaacccgccccctccgccgcctccttctccgcaggaacagaatcacacccagccgccgccggacgcagacggcgagcaggagccgaatcctgccagccatggttcggaacaaatcttcgccgccgcgccggccggcgacatcgcccgcatccgcgtccaggcgccctcgtccggcgacgcggccggccgccgcagcgacggcgccagccgccagcgcggccattacgtgcgcgcagaggccaacccacagccggcccagctggcgctggatgccacgctgcgccacgcgctgctgcgcgatccggacaacttcgccgtcacccgcgccgacctgcacgacaaggtgcgcgtcgccaagcagggcaatctgattctgctggtggtggacgcctcgggatcgatggccgcgcgccagcggatggagcaggtcaagggcacggtactaagcctgctggaagacgcctaccgccgccgcgaccaagtggcgctgatcgccttccgcggccagcaggccgaactgctgctgccgccgtgcaaccgcgtcgaacaggccgagctggcattgcgcgagctgcccaccggcggccgcacgccgctggcgcacgcgctggcgctggccgccgacacgctgtcccgccaactgggcggcccggccccactgctggtgatcctgagcgacggccgcgccaatgtggcgctggatggcgacggcgacccgtggcggcaggcgctggacctggccggccagctggccggcgcgccggcgctggtgctggacaccgaacaggacttcgtccgcctgggccgcgcccgcgagctggccgaggcgctgggcgcggaatacctggcttgcgacgccctcaccggcgagcagctgacattgacgattcaacaaagactgggccgctgagatgacgggcaaggtttacctgataggcgccggccccggcgacctggacatgctgacgctgaaggccgcgcgttgcctgaaactggccgacgtggcgctggtggacgatctggtgcatccggacattcgttccatgctgcggccggacgccgaaatcgtgccggtaggcaagcgcggcggctgcccgtcgacaccgcaggcggccatcgagcagcggatgatagacgaggcccgcgccggcaagacggtggcgcgcctcaagggcggcgaccccttcgtcttcggccgcggcggcgaggaaatgctgacgctgcaagcggccggcgtcgaggtggagatcgtcaacggcctcagcgccggcctggcggtgccggccacgctgggcattccgttgacccatcgccatttcgtccacggcgtgaccttcgtctccggccatccgcaccaggacggcgacgagccgaactggcaggcgctggcgcaaagcggcatgacgctggtgatctatatgggcgtcaagcggctgccctggatccgcgcggagctgctgcgccacggcctgaaacccgacaccccggcggcggcgatagaaaacggcacgctgccgcagcagcgccaagtgctgagcacgctggacgcgctggaacaagacatgcgcgcggccggcatccacagcccggcgctgatcgtcatcggaccgacggtggcgctggcgtcctgtagtccgtccgccgccaatgaaacaaccaaggaatacgcatgatcatctgcataggcgccggccccggcgacatcggctacctgccgcagcgctcggcccaactgatacgcgaggccgacgtggtggctggcttcaacgcggtggtggacgtggtccgcccgctgatccccgacagcgccgaagtgatccagatgggctaccgcgaccaggtggcccagctggacatcgtcgccgagcgccaccatgccggcaaaaagtgcgtggtggtgttcatgggcgacatccacttcagcggcttccagtacctggagcgggtggagcgcgcctgcggccacccggtggaaacgatacccggcatctcgtcggcgcagatcctggcctcgcgcggcaaggtgtgcttcgacgaaaccagcttcatcaccttccaccgccgcggcgacctgacgccgttcaagcgccacctggtgcacgtgctgcaggacggccgcaacgccatcgtcatcccctgcccgtgggatgaggcgcgctccttcatgccctggcacatcgccgcctatctgctggaaaacggcatcccggccggccagccggtggaagtgtgggaaaacctgacccgcaacgaggcggcatggcgcggcacgctggccgaatgcgccgagcagcgcttctccgacatgagcatcatgctgatccgcacgctcgcgccgatggacagccagatcgagccgacccacaaatgagccaatcagactacgccatcgtattggccggccacggcagccgcgacccggacggggtgaacgagttcatgcagctggtggacgcgctgaaggcgcgcgccggcgtgcgccccgtcgcccacggttttctggagttcgcccgtccgacgatagacgaggcggtggaacaggtaatcgccgccggcgccaaaaccgtggtgatggtgcccggcgtgctcttggccgccacccacgccaagaacgacatgcccagcgagctattggcgctgcaacagacgcatccgggcgtcgatttccacttcggcgcggcgctggacctgcatccgcggctgctggcgctgtgccgccagcgcatcgtcgaggccgaagccgcgtcgccgcacaccatctcgcgcaacgacgcctgtctggtcgtggtcggccgcggcacctcggacccggacgccaactccgaaatctccaagctggcgcggatgctggaggaaggcctgggcttcgccgcgtctttcgtctgctactccggcaccgccaagccgctggtggccgacggcctgcgcgccgccgccatgctgggctaccgccgcatcgtggtgctgccctacttcctgttcgacggcgtgctggtcaagcgcatctacggcgcggcggcggacctggcggcgcgccacccggaaatcgaggtgctgagcgccggctacctaggcccggacccgcaagtggccgaggtattcctggagcgcgcgcaggaaggcgtggaaggacgcgcggcgatgaactgcgcgctgtgcaagtaccgggtgcagatcgtcggcttcgagcagcaggtgggcgagccgcagcgcggccaccacggcaaggtgcgcggcctgctggaacgcgagccaaccgccaatcagccgccggcctggaaacgctacaccccgcatccgatcgaagccgaaagcatgcgcatcatagacgaaggccgcgactggtcggccttcccggccgaacagcgcaccgcgctgatgcggctggtgcacaccaccggcgacttcaacagcgtggacgacctgttcttctcggccggcgcttgcgaaaccggcatgcgcgcgctgctgcgctgccgccgcgtggtcaccgacgtcaccatggtggaaaccggcctcaagcgcgaggtgctgcgccagctggaagtggaaacctggtgcggcgtgcacgacgaggaaacccggctcttggccgaagccagcggcctcacccgctccgccgccggcatccgccgggcgtggcagaaattcggcaacgactgcgtggtggcgataggcgacgcgccgaccgccatccgcgaggtagtgcggctggtgcgcgatcacggctggcggccgcagttggtcgtcggcctgccggtgggcttcgtcggcacccgcgaatgcaaggaagagctgcgcgcgctgctgcaagtgccgcgcatcaccaaccgcggcacccgcggcggctcgccgtgggcggccaccgtggtcaacgcgctgatgatagacgcgatcgaacacgttcatcagcagcagcaacgggaagaatgagcccggtgcgccagccctacgacctcgccgcccccgcgcccaacggcatgcgccgcggccgcaccaccggcagctgcgccaccgccgccgtcaaggcggcgctgatgctgctgctggacggcatcgacgccgacgaggtcttcatcagcctgccggacccggacttctacctggcggtgccggtagagaacgtggcctggctggacgaaaacaccgtgcgcgccgaagtgctgaagtacgccggcgacgaccccgacaacaccgacggcgcgacgatcttcgccgaggtaaggataaacggcagcggcgcgctgcgtttcctggccgcgcccggcgtcggcatggtcacccagcccggcctgcgcatcccgcccggcgagccggcgatcaacccggtgccgcggcagatgatgcggatggcggtggatgaagcgctggccggccggcccgaccccggcatcgacctggcgataggctgcgtcgacggcgacaagatcgccaagcgcaccttcaacccgatgctgggcatcgtcggcggcatctcgatcctgggcaccagcggcatcgtcgagccgatgtcgcaggcggcgtggatcgcgtcgatcgaggtttatgtgcgggtggcgctgggcgagctgccgactgccatcgccttcacccccggcaagataggccgcggctacgccgccgacaggctggggctagccaagaaacaggttgtccagatcgccaacttcgtcggcgactcgctggacttcgccgaatcggtgctgatcgagcagggccgcatcctggacacgctgtgggtgctgggccacccgggcaagatcgccaagctgttggacggcgtatgggacacccattccggcaagagcggcatggcgatggacgccgtcgccgacgtagcagccgacctgggccatgcgcccgaactggtggcgcaaatcaaacaagcgaataccgtggagaacgtagtgcagatcatgagcagccagccggacgcgcgcggctactggatggaaatagaacgccgcaccgcggcgcggatggcggccaaggtgcccagcgtgcggcaagtggcggtgcgcctctttagcatggacggcaccccgctgggagaagccgcatgaagctgggcacgctcataggcataggcgtgggccccggcccggccgggctgattccggtggcggcgctggccgcgctgcgcgaggccgacatcgtctacctgccgcgcgcgacgtccagcgacacgtctgtcgcccgactatgcctggccgggctggaattggacgagagccgcttccgcgaaatcgagttcgaaatgaatccggaccgcggcgcgctgtcgcgccattacggcgcgctggccgagcgactggccgccgaactgaaaaccggccggaacgtcgcctacctgaccataggcgactcgatgacttactccacctatggctacctgctggcggcgctgcgcgaaatgctgccgcagctggagacgcagaccttccccggtgtcaccagcttcgccgccaccgcgtcggccttgtcctggccgctgggcgaaggcaaggaacgcatcctgatcctgccctgccccgacgacatggccgagctgcaagccgatatcgacagccacgacatcgtggtgctgatgaagataggcaaacggctgccggacgtgctggcgctattgaacgatatgggcatcgcccagctgtgcgccttcgcccgccgcatcggcctgcccggcgaagtgctgtgcgccgacgcctcgcaattgacggccgacgccagcggctacctcgccaccatgctgatccgcaagacagccagagaaagacgccattcatgaaagtgtatttcatcggcgccggccccggcgccgccgacctgatcacgctgcgcggcagccgcctgctgggcgcggtgcccatggtgctgtacgccggctcgctggtgccggccgagatgctgagccactgccgcccggacgccgaaatccacgacaccgccgagctgaacctggaccagcaggaagcgctgtaccgccgcgcccaagccgaggacaaagacgtggcgcggctgcactccggcgacccggccatctacggtgccaccaacgaacagatgtgccggctggaagcgctgggcatcaaatatgaggtcgtccccggcgtgtcctcgttcaccgccgccgccgccgcattgggcagcgaattgacccggcccgaggtgtcgcaatccatcatcctcacccgcaccagcggccgcgccagcgcggtgccggagaccgagtccatcgccagcttcgccgcccaccgcgcgacgatgtgcatcttcctatccggccagcggctgaaacagaccgtcgccgacctgtcgctgcactacccgcccagcaccccggtggcgctggtgcgccgcgccagctggccggaccaatccgtccaccgctccacgctgggcaagatgctgtccgaggtgaagcagaaagactggctgctgaccacgctgctgttggtgggcgaggcgctgtcgcgcgaaggcggcgtcgaatccagcctgtacgcggccggcttcacccacatcttccgcgacggcgacgaacgcaagaccaagcgggccagcctgcggaaagaaaaccaggcatgagccgcgccgtgtggctggtgcgtgccgaggcgctgcccttgggccaaaagctggcatcggcgctagacgccaagctataccagccgtggctggatgcggatgccagcggccgcgagcaatttcgcgccgccttccacctgcacagccactgggtgctggtgatggccagcggcatcgccgtccgctatctggatggcctgccgcaaagcaaatacagcgacccggcagtggtggtgatggacgaagccgcccgcttcgccatcccgctattgtccggccacgaaggcggagcgaatgaccttgcctacgaagcggcgcggctgaccggcgccatcccggccgtcaccaccgcgacagaagcgatcaagccgctgacgctgggcatcggctgccgccgcggcaaaagcgccgaagccatcgaacaagcggtatcgcaagccttggccggccggccgctgtccgacgtgcgcgaagtggcgaccatagacctgaaggccgacgaagccggcttgttggcattctgcgcccaccacgcgctgccgctgcgcgtcatcgcccgcgaagacgtcgccgcccgcggctggaccggcgcgccgtcggactgggttcggcggaacgtcggcgtcgacggcgtgtgcgagccgtgcgcgctgatcgccagcccgcgggggaggttgatcgtgcccaagatggcattggatggggtgacggtggcggtagtggaggatgggccaattgtttgagttcaaaaaacaagctgtgcctgctttgcaggcatcatttaggggcagttccaccgccaggggcaaggggggctgcgcggccagccccccttgcagcccccaggccgcccctacgtgccgcgaacccccaggaaaaacgcggtcggcaaggcaccgccgaactcgccgcgcgctagcgtcgcgcggctcaaacagacggcggcttaaaaccttgccgaccgcgtttttcccggcgcgtcccgaaggggacgactcggcgtatcgtcaatgttttgcgcaaccagaaggttatcaatggcgcagtccacatgggcaaacccagcgcttatctattcatgcgtcacaaataaatgcaacggtagcaatcctagcaaaggatgaaatgtcggtggcgcacccccactcccctttggcgcgcgccggtaaaaatcaggctggcaaggttttaagctgccgcttgtttgagccgtgcgacgctagcgcgcggcgagttcggcagcgccttgccagcctgatgtttgccggaaattcgcgcgacgcaggggcggcctggggttgtaagggcgctggccgcgcagcccccttacccgcccaccgggcggaaccacacatcaacagcgccaaaacaattacagaatgcaaaattaagagaacacatccatgaccggcaaactctacctcgtctcggtcggccccggccgcgccgaactgatccccgaccttgcccgccaggcgctggccgcgagcgacgtgatcgtctcctacgacctctacctgacctgggtgcaaccatggatcgccggcaaggacatccgcacgctgccgctgacccaggagcgcgaacgcgcgcagctggccctggacgaagcccgcgccggcaagaccgtggccttgctgtccagcggcgacatcggcgtctacgcgatggccacgctggcctacgaagacatgcgcgaggacgatagcttcgacgtgcagctgatccccggcatcacctcggccaactcctgcgcgtcgctgctcggcgcgccgctgtcgcacgacttcgccacgctgagcctgtccgacctgctgtgcccgtgggagtggatcgaaacccgcgcccgccacatcgcccaggcagacctggcggtggtgttctacaacgtgcaaagccgccagcgccaggagggcgtctaccgcatcctggacatcatgctggagcacaaaaagcctgagacattgtgcggcatcgtccgcaacgcctaccgcgaagaccaggcggtggaaatcgtcaccctggccgagctgcgcacccgccgcttcgacatgctgaccagcatcgtcatcggcaaccgcttcacccgccgcaagcgcaactggatgttcaccccgcgcggctacttcaactgggacaacaccagcgacacggtgaaggccgacgcgctgcccgccggcgccgcctgggtgttttccggcaccagcgacggcaacgcgctgtcgcgcgccatcgccgaaaccggccgcgcggtggtggtcagcagcgccagcgattacggcaacgagcaagcgcagcaggccgtgcccggcgtcgccaccgtcagcggccggctgggcgtggagcgccgccgcgagctgctgtccggcagcagggcttcggccatcgtcgacgccacccacccctacgccagcgagatgtcgcagcagctgatggcgctggccgaggaactggccctgccctatctgcgctacgaacggccggccagcggcagcgcgcatccggtgatccgctgcgccgacagcgatgcagccgccagaatggcgatggcgaaaggacaccgcatatttctcgccaccggcagcaaggagctgcaccgcttcctctccgccgacgcggagcacaaacatcaatggttcgtgcggctggcgccggacccgcagcacctgcagcgggcgctggacttaggactcccgcgttcgcgcatctgcgcgatgcaaggcccgttctcgcaggccgccaacgaggcgctgtggcgcgactggggaatcgactgcgtgatcagcaaggacggcggcgaggccggcggtttcgacgccaaggccgcggccgcggcggcgctgggcatcccgttcatcgtcatcgaccggccgcaactggactacccgcaatctttcgacgatttcgagtccgtgctggcggtcctgccgcagggaggccaggcatgagcgcgccgcgccttcccgtcaccgtgctgaccggtttcctcggcgccggcaagaccacgctgctgtccaagctgctggaaaacaacaagcaacgccggctggcgatactcgtcaacgagttcggcgaggtgtcgatagacggcgggctgctgcgcgacgccgacgccggcggcgtggaaatccacgacctcgccaatggcctggtcgcctacgacgacgacgccgacttcctgcccaccatgctggcgctgtggcagcgccgccagcagatcgaccacgtgctgatcgaaacctccggcctcgcgctgcccagcgcggtgatggcgcagctgcaaagcgaggcgctggcgccctatttcgtgctggacgcgacgctggcggtggtcgacaccccgctgctgctggccggccacttctccccggccggcaacggcggcgaggccgacgcggtggcggaactgttcgaccagcagctgggccacgccgacatcgtggtgctgaacaagatagacgcgctgtccgcagatgaactgctggcggcggaggaaaccgtgcgccggcaggcgccgtcgatccgcttcatcgaactggcctatcaagccaggctggacacccggctgacgctgggcctgcatctgcacgaggccgcgccggccgcgcaccgccattacggcccggtggccagcatgccggggctggcgatgcggccgctggccaaccaaactttgctcgatggccacagccacggcggccaggccgcgcacagccacggcctgtccacccacaagcatttccacgagcaggacccaggctggcaatcgttcatgatacgcagcaaggagccgcagcatgccgacaagctggccgcggcgctggaggccatcgcccgcgaggagccgctgctgcgcatcaagggcttcgccgcctgcgccgacggccccggccggctgctggcccaaggcgtgcgcaagcgcatcgaactgagccgcgacgaggcgctggccgcgccacgccaggcgcagctggtgttcatcggctaccaccccagccgcccgcgcgtggtggccttgctgcgcgacatcaccggcgcgcactggagctaggcggtgagcgcattggaactatgcggcctggactggtcgcccgatccgcgctgcgcgccggaagagcggctgctgcgcggcatcgcgctcaccgtccggcccggcgagttcgtcggcgtcatcggccccaacggcagcggcaagaccagcacgctgcgctgcgccttccgcttcaaccagccgctggccggcgaggccaggctggacggcgccgacatctggcgccagtccgccgccgccttcgcccgccgcgtggcggtggtgctgcaggagttcccggaggacttcggcctgaccgtgcgcgaggccgcggagatgggccgcatcccgcaccagtcgctgctgcgcggcgcgccagcggacgatgccgacatcgtcgacgacgccttgcgccaggtggggctgctggagcggcaacaccagtccttcgccacgctgtccggcggcgagaagcagcgcgcgctgctggcgcgggcgctggcgcaacagccggaactgctgatcctggacgagccgaccaatcacctcgacctgcgccaccagctgtcgctgctgcgcctggtgcgccggctgggcatcgccgccgtcgccaccctgcacgacctcaacctggcggccgccttctgcgaccgcctgtacgcgctgcaagagggccgcatcgtcgccagcggcagtccggccgaagtcctgactgccgacctgctgcgcgaggtattcggcgtgcgggcgctgatagacgcgcacccgctggccggccacccccgcatcaccctgatcaccgaagagcatagccatgagatttgactttcccctgctgctggccgccggcctcgccgccctgtccgccgtccaggcgcacgccggccattacccgctgaccgtccagagctgcaaccgccaggtgactttccagcgcgcgcccgaacgcgcggtcagccacgacatcaacatgaccgagatgatggtggcgctgggcctgcaaaaacgcatggccggctatagcggcatcagcgcctggaacaaattgaatgccccattgaagcaggcgctgggcgcgttgccggagctggccggcgactacccgtcggccgaggccttgctggcgcgccgcgccgacttcttcttcgccggctgggattacggcatgcgtgtcggcggcccggtgacgccggcttcgctggcgcccttgggcatcaatgtctatgaattgagcgaatcctgcgcccacgtgatgaagcgcccggcggccagccttgccgacgtctaccgcgacatcggcaacctcggccgcatcttcgacgtggagccgcgcgcgcaaaaagtcatcgccgagatgcgcgccaaagtggacagcgcgtccgcccgcgtcgccaagcgccaggccacgccgtcggtcttcgtctacgacagcggcgaagaccgccccttcagcgccggccgtctggcgatgcccaacgcgctgatccaggccgccggcggccgcaacatcctggacgacgtcgacgccagctggacccgggtgaattgggaaacggtgatcgcccgcaacccgcaggccatcgtcatcatcgactacggcaaggtgaccgcgcagcagaagatcgccttcctgcgcaaccacccggcgctgggcaagctggacggcgtgaagaaccagcgcttcatcgtgctgccctatgacagcgcgacgcctggcatcgccaatgccgacgcggtggtggcgctggcgcgcggcctgcatccgcaggccttcgcccggtgagcgcgcccgccttcgcgcgcggcccggcgccgctgccgcccattcttctggcgctgctggcggcgctggccgcctcggtgctgctgaccgtgggcctgggccccgcgccggtcggcctggccgatagctggtccatcctgctgcatcagctgggcgcgccggtcgcccccgcctggcagcccggccaagacctgatcgtctggcagctgcggctgccgcgggtgctgctgggcggcctggtcggcgccggcctcgcgctggtgggcgcggtgctgcaggcggccacccgcaacaagctggccgacccgcacctgctgggcgtcagctccggcgccacgctgggcgcggtgtcggtgctgctgttcaccggcaacctggccggcagcctcaccttgccgctggcggctttcgccggcgcgctgctcagcaccgcgctggtgatggcggtcgcgctgcgccagcgccggctgcaggccgaacgactgctgctggccggcgtggcggtgtccttcttcatgatggcgctggccaatctgctgatctacctgggcgaccaccgctccacctcgtcggtgttgttctggatgctgggcggcctgggccaggcgcgctgggaactgctgccggtgccggcgctggcgctgggttccggcctgttggcgctggccgcgctgggccgcccgctcaatgcgctgatggcgggcgaacagaccgccgtcacgctgggcatacaggtgtcgcggctgcgcctggcggtgttcgccgtctcctcgctgatgaccggcgtgatggtggcggtcagcggcgcgataggcttcgtcggcctgatgattccgcacatcgcccgccgcttcgtcggcgccgaccaccgccggctgctgccggtgtgcgcgctgtccggcgccattttcctgatctgggtggacgccgccgcgcgcacgctgatcgcgccggaggacatcccggtaggcgtcggcaccgcggcgataggcggcgccttcttcatctggctgatgcgcgcgcgctgagccgccgcttcgccattccctcaaggagccaaacatgaaaaccgatccggcatcccaccaacgcatggccgagaagcgcaaggcgggctttgaaaagaaaaaagccgccgccaccaaggaaaaaggcctgctcatcgtccacaccggcaccggcaagggcaaaagcagcgccgccttcggcatggggctgcgcaccgtcggccacggcatgcagctgggcgtggtgcagttcatcaagggcgcgctgcacaccgccgagcgcgacctgctgggcggctttcccaactgcgacttccacaccatgggcgaaggctatacctggaacacccagaaccgcgacgccgacatcgccaccgcacgcaagggctgggacgaagcctgccgcatgctggccagcggcgaatacgatatggtgatcctggacgaactgaacgtggtgctgaaatacgaatacctgccgctggacgaagtgctggccgccttcgccgcccgcccggccgacctgcacgtggtggtcaccggccgccacgcgccggaagcgctgatcgaagcggcggacctggtgaccgaaatgcggctggtcaaacacccctaccgcgaacagggcatcaaggcgcaacagggcgtggaattctgagatggaaacccgccactgcccggcgctgtttctcaccgctcccgcctcgcaccagggcaagaccacgctgacggcggcgctggcgcggcatcaccgcaagcagggccgccgggtgcgggtgttcaagaccggcccggactttctcgacccctacatcctggagcaggccagcggccacaccgtctacggcctggacctgtggatgaacggcgaggacgactgccgcgcccggctgcatcaggccgcggcggaagcggacctgatcctgatcgagggcagcatgggcctgttcgacggcacccccagcagcgccgacctggccgagttgctgggcgtgccgctggtcgcggtgatagacgccgccggcatggcgcagaccttcgccgccgtcgcccacggcttggccagcttccgtcccggcctggtcttgcacggtttggtcgccaaccacgtcgccagcgagcgccatgccgaaatgctggcccagcagttgcccgtccatctgccgctgctggccgcgctgcgccgcgacgaggcggcgcggctgccggaacgccacctgggcctggtgcaggcgcaggagatcgccgatctggacgccaggctggagcgttcggcggcgcagatcgcgggcaccgccttggccgcgctgccgccgccagccgcctttcccgccatcgcgcagcctgccgtgcccaggcagctggcgggcaagcgcatcgccatcgcccgcgacgccgccttcgccttcgtctatccagccaatctggaaacgctgcgccagctgggcgccgaactggccttcttctcgccgctggccgacgccgcgctgccggactgcgacgccgtctacctgcccggcggctacccggagctgcatcttgaaacgctgtccgccaacacggcgctgaaagcggatctgcatggacacgtcgaagccggcaagccgctgtacgctgagtgcggcggcatgctctacctgctggacaggctgaccaaccgcgataacgacaacgcggcgatgctggggctgctgcccggccacgccacgctgcaagcgcggctgtgcgggttgggcctgcagcaaatggacttccccggcggcgcgctgcgcggccataccttccactacacccggctggaaacggctctggagccaatcgcccgcgccgagcgcgccagcggcgccggccagggcgaggcgctgtatcgccgcggcagcctgctggccagctatttccacgcctactttccgtccaatccccttgccaccgcgagcctgttcctgtcatgaaccgttatccgcaagccgacatcgacgccatctaccgcgctatccgcgaacgccgcgacatgcgccacttcctgccggacccgatcgattccgaaaccatgcggcggctgttggccgccgcccacttcgcgcccagcgtcggcttcatgcagccgtggcgcttcatccgcatccgcagcgccgaactgcgcggccagctgcacgcgctggtggagcaagagcgcatccagaccgcccgcgcgctgggcgagcgcgaagacgagttcatgaaactgaaggtggaaggcctgctggattgcggcgaagtgctggtggcggcgctgatggacggccgcgagcggcacgtgttcggccgccgcacgctgcctgagatggacctggcctcggtggcctgcgcgatccagaacatgtggctggccgcccgcgccgaaggcctgggcctgggctgggtatccatcttcgatccggccaagctggccgcgctgctggccatacccgccggcgcgcggccggtggcgatactgtgcatcggccatgtcgaggcgttttacgagaagccgatgctggagcaggaaaactgggcccgccggcaaaacctggccgacctggtctacgacgaccgctggcccggccaggcctgagcgcgcccgccattgcagccatcgccccatgaaaatatccattgaatttatttaataccgcacaataattcaaatggcatttaaatggagaagacgatgaaaactgcaaaaacaatggcggcgctatggctgctggccatcggccatctggcgcatgccgatgcgacggtgccgcgctgggcggtgcaagccgaagggcggcaagtccgccacgccgacggctggcaggccacctggcccggcgtcaactggcaggtccgcgtcgccgcccaggcggtgggcgtcacgctggacgacgcggtcaactactatgcgctggaagtggatggcaaggcggtgcaaaaaatcggcccggccgccggcgagcgcacgctctggcaagacctgccggaccgccgcccgcacatcgtgcgcctgttcaagctgacccagtctccggacaatcccggctggttcaaaggattttcgctgcgccagggccaagtgctggagcagccgcccaagccgcgccgccagattgaattcatcggcgattcctggaccgtggcctacggcaacctgtccaccacccgcgactgcaccgatcagcaaatcgtcgagcgcagcgacgccagccagagcttcgccgcttatctcggcaaacgccacggcgcgcaaattcagaacgacggcatgtccggcatgggcatggtgcgcaactggggcggcaatatgccggaagtcgactaccgcagctatcatccgcggctgttgcagaacctgccggccagcgcgccaggcaacaacgccgagcatcgcgacaactggcggccgcagctggtggtgatcgcgctcggcgtcaatgatttcggcaccgatgtcggccctggagaaaagcgcagccagcagcagttggccgacgactacgtccaggcctatcacggcctgatcgcccgcctgaagcagcgctacgacaaccccgccttcctgctggccgccacttatctctggccagccgaccggatgcggccgctggtcagccgcatcgccgacgaggaaagacagcaagggacgacggtggcctacgtggactggcaaaacatagagctgaccggctgcaactggcaccccaacttatccgaccacgccaaaatggccgaccagatggacgccgccatccgcacgctgggcaatatctgggacaagtaagccgctgcccgggagcgcaggccagtcccgccctccccgcgcgtcgtcaatcccgaacctcccactgcggattccaggccacctcccacagatagccgtccggatcctggaaatagccggcatagccgccccagaacgtgtccatggccggcttgacgatggtgccgccggcgcgcgccgcctgcgccatcgtttcatctacctgcccccgggaggaaacattgtggccgatcgacacgccggcggcggcggcccgcggctcaggcaggcccgcgtcatgcgccaggctggcgcgcgggtacaacgccagcttcaaaccgccttccagttcgaaaaaggcgacggcgccgtgctcgaactcggcgccgactatgccctcgcttgccagccccaaaccgtcgcggtaaaaacgcagcgcgcgctgcagatcgtccacccccagcgtcagcaaagtgatgcgcggcttcataagcctaccctccggatcagcgtcctttgaaatgcggcgcctgcttgtcgagaaaagcgcgggtgccgatgcggaaatcctcgctctgcgccgccaggccgaaataatcggcccccagccgcgccgcctcgtcttccgtcaggctaaggccgcggtgcaacgcctcccaggtgagccgcaccgccaccggtgactgcgccatcacctcgcgcagcaaagcctccgattccgccagcaaatctgcggcggccaccacccgattgatcaggcccagccggcacgcctcctcggcatcgatcagcctgccggtcagcagcagctccgccgctctgcccttgcctatcagcctgggcagccgcgtggtgccgccgaaaccggccaccgcgcctatcctcacttccgggtggccgaaacgggcatgcggcgcggccagacgcaacatgcaggcttcggcgatttccaggccgccgcccagcgcgtcgccgttgatcgcggccagcaccggcttgccaagcgcctctatcctgcttgtcacagccaccgccagccgcgccagctccctcacctcggccgccgaagcctggctgagaaagcggatgtccgcgccggcggaaaacacccggccgctgccgcaaaggatcagtgcccgcgccgattcatccaccgcggccagctccagcgccgccagcagctggcgcagcagcgggcggttcatcgcgttcaggcagtcgggccggttcagcgtgatccggccaatgccatcttccacctggtaacgcaccacatcctgctcgaacataagccctcctcgcagcaaagcggcggccaatccgccgtcagtcaaaccggaagcggcgcttagcccgccgcccactccatgtaatcggcggacgcgagaaagccttcctgccgatacagcggccgccccgcctccgtcgcatgcagccagaccttgccgtaaccccgccgctgcgccagcgccagcgcgctgcgcacgatcgcccgcgcatggccctggccgcgatgatccggcagcgtgtacatattcagcaaatacgcgtcccgcccggcggcattgcccggataaggcggccgagcgaacaccgccagcgaaccgatggcgaccacctggccggcctcctccgccacccaggtgacgcaatcgccgccttgcagcgcctggcggaaatacgcgatggtggcggcgcggatggtttcgtcggggccgacgccgttgagcgcggccgcgtcgtcgaacagccgcatgcgcagcaggactatggtttccagatcggaaggaagggcttggcggatgatggcgggcatgaagggaagcggcgcgttggccgacgatatgatccaccgccagaatagcacatgagcataggcgtgataggccagactatctttatcgtccggatgaagaaagcggcgtcacgaccacgcggcaaaacctgcggccccctccggcgagcatgcgccatcccgccgccggacgcccggcggcttcaattctcgacgcgcagttgccgctgcagacacgccgggcacaggcagtcgctgtccgccgcgcttggcgacaagcgccgcggcagatccgcgcaccagcagccgcccgcctcgccgcccgccccgcaggtgaagccaccgccgcaacgggcgcaggtcttggcctgcaccggcacaggcaaggccaacaggcgctgccagacccgctccttctcttccttgccatagctggaccagccggcgatctcgtccagcgtgcggcggcagccgacgcacacctgcccgctctcgtccaggcggcagatgccgatacagggcgatggcggcggcgtttccatgcttgtccgtttcattcgcctctcccattgaaattgtcgtagtcgatattagcgcgcgtctggccgtttgtgcgcgcaaacaaaaacggcgcggaagtccgcgccgttcgtcatggagaaagctggcttacttggctgcggatgcgtccttggccacgccgccgccgacggtttccagcactttccactggccgttttccaccttgtaaacggtgatgccgccgtctttcaggtcgcccttgtcgtcataggtccagttgctggaagtcacgcccttgtgggtgatcttggccagcaccggcatgtagaccttgggatcggccgaattggcgtccttcatcgcctggatcagcgtgcgcgcggcgtcgtagccgtacggcgagtaggtggccacatcggacttgaaacgggccttgtagcgcgattcgtagtccttgccgcccggcatctgctccagcggcaggccggccagcgaggcgatggtgccgtcggcttccttgcctgccagttgcaggaaagtcggggtcttggtcatttcgccggagatcagcggcgccttgatgcccaggcgcttcatctgcttggtcatcggggcggactgcgcgtcggcgccgccgtagaacaccgcatccgggttcgcgcccttgatgctggtcaggatggcggtgaagtcggtggccttgtcattggtgaactcgcgcttcaccacttcgccgccggccgcgcgggcggacttctcgaattcgtcagccaggccctggccgtaggcggtgcggtcgtcgacgatgacgatcttcttcgccttcaggttctgcaccacgaacttgcccatcacgccgccctgctgggtgtcggaggtcatcgaacggaaggtgttcttgaagccttgcgcggtgaataccggcgaagtcgccatcgcgatcatcgggatgccggcgtcggagtagatcttggaggccgggatcgaagtgccggagttgaagtggccgacgatgccggcgactttctcgtcgacgaacttctgcgccagctgggtggcggttttcggatcggcctgatcgtcctgggcgtccagttcgaaggtgaccggcttgccggcgatggtcggcttctcggcgttggcgtcttcgatcgccagggtcacgccgttcttgtattcctcgccgtagtgcgattgcggaccggtcaagggggcggcgaagccgatcttgaccacgtcgccgccagcgctcgcctgggccggagccgaagcggcgcctgccggagcggcttcttccttcttgccgcaggcggacagggcgacagcggcggcaaccgccagagtcagggtagacagcttggatacttgcatctcttcagttcctctcttgcttcaacacaaccagccagcaggccggctccagtcttgctcttaaagtaaaaactctggccgcattatttcaacgcggccggagcctggcaagttgattattcgctcatgctcatcaggctggcgttgccgcccgccgccgtggtgttgacgctgagcgcgcgctccaccaccagccggtgaatattatagccatgcgcgtcgcgcaggatcagttgcgccagcgcgccgtcgcgggcggctaggcggcggcgcgcctcctccgcgccagagccggcgaacagcaccgcgtccacgtcggcggccagcacgtccgccgccagttcgacatggctacccaattgcgcagccagcttggcgccggcgccgtccttggccaataccgcgcggttgccggcggcgaacaccgcggccagctgttcagccagtgcttgcgcgtcgtccgccacgcagccgatgcggccgcggccggcgaagcccagcgtgttgttctcgccggtcggccccggcagcgccacgctgtgcgccaatgggctttccttgcgcgccgcggcgatagcgccatccaacgccagcccctgcgccttggcggcggcggccaacgcctccagcgccggcagctcgacggcagcgttaacggcggccagcttcggctgccaggcggcgcggctcaagcgatacaagtaatacggaccgcccgccttggggccggtgccggacttgccctcgccaccgaacggctgcacgccgaccaccgcgccgacgatattgcggttgacgtagacgttgccggccttgatcttgccgcagatgtcggcgatggtttcgtcgatgcggctatgaatgccgtgggtcaggccgtagccggtggcgttgatctcggccaccacctggtccagatcgctggcggcgaagcgcagcacgtgcagcaccgggccgaacacctcgcgcttcagttcggacagattgtcgatctcgaacagcgtcggcgcgacataagtgccctgctcgcactcgctggacagcctggtctgatgcaccgccctcgcggacttcttcatcttttcgatatgggccagcaagccggcctgcgcctccgcgtcgatcaccggtccgacatcggtggtgagcttggccgggttgcccaccgtcaactcgtccatcgcgcccttgatcatcttgaccaccttgtcggcgatgtcgtgctgcaggtagagcacgcgcagcgccgagcaacgctggccggcggagtcgaaggccgagctcaacacgtcggtcaccacctgttccggcagcgccgagctgtcgactatcatcgcgttcatgccgccggtttccgccaccagcacggtgtcgtcgctgcgcttggcaagcgtgcggttgatgatctgcgccacttcggtggagccggtgaagatcacgccctggatgcgcgcgtcgccggtcagcgccgcgcccaccacctcgccgcggcccggcaggaactgcagcgcggcgcgcggcacgccggcttcgtgcagcaggcgcacggcgtaagcagcgatcaggctggtctgctcggccggtttggccagcacggtgttgccggcggccagcgacgcggccacttcgccgatgaagatggccagcgggaaattccacgggctgatgcacaccaccgggcccagcggctgatggctggcgttgtcgaattcggcggcgatctgcgcggcgtagtagcggcagaagtccaccgcctcgcgcacttcggcgatggcgttgttcagcgtcttgccggcttcgcgcaccgccaggcccatcagcgccggcatattggcttccatcaggtcggccatgcggttcaggcaggcggcgcgctccgccaccggcgtggcggcccaggcggcggcgtagccggccgattgcgtcagcgcgcgctccacatcggcggggctggcctctatcaccttgccgacgatgtcggcgtgattggccggattgcgcacctccagcaactggccgtcgctgacatcgccgtcgcccagcatcgggaaagccgcccagcgttgctgctcggacgcctgcaggcccagctgcagggtagccagcacgtgctcgctggacaggtccaggcccttggagttgcggcggccattgccgtacagctcggccggcagcgcgatcttgccgtgcggcgcgccggcatggcgggccgcttcggccaccgggtcggtcaccagttcggcgatggacaccgcttcgtcgacgatgcggttgacgaaggaggagttggcgccgttttccagcaggcggcgcaccaggtaggccagcagggtttcatgcgaacccaccggcgcgtagatgcggcaggccttgcccagcttgtccttgcccaccacttggtcatacagcgtttcccccatgccgtgcaggcactggaattcataatccagcccggtggccaggtcatagatcgccgccaggctgtaggcgttgtgggtggcgaattgcgggtagatggcgtcctgcgcggccagcagttttttggcgcaggcgaggtaggacacatcggtgtacaccttgcgggtatacaccgggtagcctggcaggccatccacctgggcgcgcttgatctcggcgtcccaataggcgcctttcaccagccgcaccatgaagcggtggctggtgcggcgcgccaggtcgatcaggaagtcgatgacataaggacagcgcttctgataggcctgcaccacgatgcctatgccttcgaagccgttcagatccggatcgttggccagcgcctccaccaggtccatcgaaatttccaggcgatcggcttcttcggcgtcgatattcaggccgatattgtactgcttggccagcaggaacaaatccttcaggcgcggcagcagttcgctcatcatccgctcatgcttcagacgggcgtagcgcgggtggatggcagacagcttcaccgaaatgcccgggccctcatagatgccgcggccgttcgactccttgccgatcgcgtggatggcggtgacgtagtctttcagatagcgctgcgcgtcggcttcggtcatcgccgcttcgcccagcatgtcgtagctgaaacgatagccgcgcgcctcgcgctcgcggccgttggccagcgcctcctcaatggtttcaccggtgacgaactgcttgcccagcatccgcatcgccatgtcgacgcccttgcggatcagcggctcgccgcccttggcgatcagccgggtcatcgcggccgacaggccggaggcgctgtgcgaggaaaccagcttgccggtcaccagcaggccccaggcggcggcgttgacgaacagcgacgagctgttacccaggtgggccttccagtcgccgcgggaaatcttgtcgcgaatcagcttgtccgcggttacgcggtcggggatgcgcagcagcgcctccgccagacacatcagggcgatgccttcgctgctgtccagagagaactcatgcatcagcgcatcgacgccgctggagcgggtgcgctcgcggcgcacctcggtcaccaagcggctggctagctgctgcaccgacttcacctgttccggactcatcgccgcctgcgccagcaaggcctgcacgcattcgcgttcgtcgcgccggtaggcggcggtgatcgcatcgcgcaaagcggtttgatgatgagcaaaagcttcaaattgcatgggtttctccgaatattgtttgcagccccggcctcgcgtccgggtaagccgtctattgtatacaaggacatcccgttttgttcgacaatataaaatattctttagcgcccaaacactaccaaaacgatagcaggccaggccatgagttcgcattccatccggacgaaaatcaccccaatcgcatagataaggctttgcagcttggcaacattgcgttgtctgtcacgcgcaaacgtagtcggatagcgaacaagcgctgtctgaaaatgacaagtcagcctagtacatttaattttaatcgcaaataactgtcatgaagctgactggaaaatgacacaacagcgggacatgcttgggagagagataagcaaaaagccccaggctgatgcctggggctttttatggggaatctggcgatgtcctactttcacatggcgaatgccacactatcatcggcgctaaggcgtttcacggtcctgttcggtatgggaaggcgtgggaccacctcgctattgtcaccagataaaacggtaacgctgctgcgtaattctattgcctttttcaggcgtaacgccaagtcatcgacttggcgttgaaatggggcgtctggcggtgtcctactttcacatggcgaatgccacactatcatcggcgctaaggcgtttcacggtcctgttcggtatgggaaggcgtgggaccacctcgctattgtcaccagataaaacggtaacgctgctgcgtaattctattgcctttttcaggcgtaacgccaagtcatcgacttggcgttgaaatggggcgtctggcggtgtcctactttcacatggcgaatgccacactatcatcggcgctaaggcgtttcacggtcctgttcgggatgggaaggcgtgggaccacctcgctatggccaccagacataaactgtacaaacttaaagaagcccgaacccgtctctcagacagattcgcatatattcggtatttgatgtacgtcgcacatccactctcttgtgtctcagtttcccaagccactcaaatgataggatcaagcctcacgagcaattagtatcggttagcttcacgcctcacagcgcttccacacccgacctatcaacgtcctggtctcgaacgactcttcagggaggtcaagcctccagggaagtctcatcttcaggcaagtttcccgcttagatgctttcagcggttatctcttccgaacttagctntatgcattagatgatataaacatctttgatgaagatgctgtttttttaagcatggtgatgaagagtgttgatgtgagcagtgtgttcttggttcgagatatagacattggcattgaaaatcataaggtggaatgtcttgtatttgatccggaaaagaagaggttggaggagtttcaaaagtttgatttccaccttgagttgccattgctagactgcgttctgttcgatgagaaatttcagtttctaatccatcgcccagcaagctttgacaaggatatgatgtattttggcccgccagcgttcctggatgtagcagttgttggtaatggatggcgaaagattttttaaggagcgtaggttgggctaagcttgcgaagcccaaggtttaccgcgaaatatacgataatgcctatggggtaggctatatcttttcattctcggtaaacgttgggcttcatttcattcagcccaatctgcggccctggttagattgatatattagattttaaaattagagtccaatttggatataaattattatgttattcagctaaggactatcatttgtgattgatcggattaatttaaatgtccttatgggagcgttttttttctacgtgcttatttttcttttcgattgcaatttttttgacgatttttatatttgcacttttggtaaatttcttaaggagttatgatgtttttgttctccagtttttgtcgtttttctttttttcggtatcagctcttgctttaggggtgattttttccgggtttttgaaagagtgtaaattttatggtggggtaattttgaggttggggtggtatttttacatcctcaaactattggtattgatttttttgggttggccagctcatagcggttgggtaatgttaagggggctgtggggatgggtggggctttgggtgtatttccctgcttggatattggagaggaggaggatgaaatggtttttaggctttccactttacttgcttcttcctgatgccatttttattataatcttttttttcagaaaggaattgattggagtgaggtgtttgcttacttgatttctctggggttttattccattttctttaagtatatttttgatttatttattcatagatttcattttaagtctaactgttttgaatcgaatattttcgtggtagttgctactgttttttctgttttaggaggaggtggtttgtttttgttcgttatttttgtttaagggttttgtgaggtggccgttctggacggtatctacggccctgtgggagtcagttttgtctgagcaagtcgtaggcttaatgtggtttagtctttcgtacgcgccatcgatatggcgagaatgcccagctcgcatgccatctggctggcgcgctcagcgcagtcgcgatccacggttctcgctaggaagaaagccgccgccatcactggcggcggcgggtttcacatgtgtttttcaaactggctgaccagccggcgcaggtcgccggcggtgaggtgcagtttctgggccacttgcagcgtggtgctgatgctgtggccgttttgctcggtcaggcggctcatggtttccatgttctgggcgacttcggtggaggccgacgactgttgccgcagcatattggccacgctggcggaggattccgccactttctcgttggcgccgcggatggcctccagcccctgggccgccacctgtatcgtcgcttcggcgatgtgcaccttgtccaccgccgccttgacgtcggccagcgcttcgcttgagcgttcgcgcaggaaggccaccgactgttctatctccagcgtgttgccggcggtgcgttcggccagcttgcgcacttcgtcggccaccaccgcgaagccgcggccttgctcgccggcccgcgccgcctcgatggcggcgttgagcgccagcagattggtctgattggcgatttccttgatcacgccggtgacggtgttgatcgattccaccgactgttccagcttgatgatggtgttgcgggtgctggacacctcgttgaccacctccagcgcggcctggcgggtgccgttcatctgcgtttcgccctgggtggccagttcggtggcctggccggcgaagtcggcgccggtgcgggtggcctgggagatttcgttgaccgccaccgacagctgctccagcgccgccgccacccggatgatgccttcctgcgtgtgttcgccgcgcgagttcagcgattcggcctcagcgtgggtggcgctggcggcttcgctgatgtcttcggctccggccaccacgtcggccaggatggcgcgcaggtggatgcgcagggtttccatttcttccagcaccgcgcgcggctcgcgcaggccggccggggcgatctggctgctgaagtcgccttcggccaggcgcatcaaggctttgcgggcggcatcgatggggggcgtctgccagcgggcggccaggtagccggccagcggcgcccaaagggccagcagggcgagtaggctgacccgcgccgcgccgccgggcagggcggcggcggccaaggccagcgccgcggaaggcagctgcgccagcagcatggccaggctcagcggcagcggcgtggtgtggcgggtttgcgggaaggcctggcgcttttcccggacgcgggcgtagagctgctcggcttcggcggtttgcgtcttggagggcgcgctgcgcaccgacatatagcccaccgggcggccgttttcgcagatcggcgtgacgtaggcttccacccagtagaaatgcccctgcttgctgcggttcttgaccaggcctttccacgggcggccggacttgatggtggtccagaggtcggcgaacgcctcttcgggcatgtccggatggcggacgacattgtgggactggccgatcagctcttcttcgctgaagccgctgatgtcgatgaaggcccggttggcgtaggtgatctggcctttcagatcggttttggtgacgatgggacggtggggcagcagaaataattcaatgctgtccacgggcaggttttttttcatcggcggcgcctcctagttctgtcattgcgaatcggcatggcaaaccggatttcgcgcggcggcgtccggtttcgagaggtttgcatccattcggatccatacggttgggatcggcttccatccctaaaaccgattgatgcccgtaaacttttcgctgctcgcctccattggcgatatagaacagaagcccgcgatgtatataagcaagtttggcgttcatttgatgtgaattgtcgtgcttaataatgagaatgattgcctgtcgccaaaagacgcggggcggggtagggcagccttgtttgatttgctgtctatataaggcaaggccttggtcatttgcgcggtgcggcaaacggcggctggcgcgtgatttttcaaggggttttatttctggcgcggcagtcgtcattttctatgaatattcagccgtaacgggattgcggttttcgctgcatgcgtttgccgagcgattgcggatttttcttggatcagcgggctgatttggcgttggcgttggcatgaatgggtctgctggatgaatgattgaattcggtcgatgcgatttggaatgcggcgcaaggcttaaagcacttgtagccaatatagacaagtggatcacggcgatggggattttgcgctaggtgcgattgcttaattggatgacgcctggcgcgagtgcgaggcggggccgcttctctgcaatcgacccgggcggccggtatggacgaggatggcgcgccgctgcggcaggtccgggagggtagcgatgcccgccggcgggaataggcgtacaattgccaacgtcttttaagggggtttgccgtcatgatttttgccaatcgctatttccctgccacccgcatgcgccggatgcgcaaggatgcgttcagccgccgcctgatgcgtgagaatgcgctcaccgtcgacgatctgatttacccggtgttcgtgatggagggcagcaaccagcagattgacgtgccgtcgatgccgggcgcgccgcggctgacgctggacaagctgctttacgtggcggaagaggcgctggagctgggcattccgatgctgtcgctgttcccggtgatcaccggcgacaaggataacgaaggcagcgaggcgtacaacccggaaggcctggtgccgcgcgtggtgcgcgaactgaaaaagcgcttcccggagctgggcgtgatgaccgacggcgcgctggacccgtacaccatccatggccaggacggcgtgatagacgccaacggctacgtgctgaacgacgaaaccaccgagatcctggtcaagcagggcctgtgccatgccgaagccggggtggacgtgttcggcccgtcggacatgatggacggccgcatcggcgccatccgccaggcgttcgaggaagaaggcttcatccacaccaagatcctggcttattccgccaagtattcgtccggcttctacggcccgttccgcgacgcgctgggttcgtcggccaatctgggcaaggccgacaagaacagctatcagatggatccgggcaatatcgaggaagccatccaggaagtggcgcaagacctggaagagggcgccgacatggtgatgatcaagcccggcatgccttatctggacgtgatccgccgcgtcaaggacaccttccacgtgcccaccttcgcctaccaggtgtccggcgagtacgcgatgctgaaggcggcgttccagaacggctggctgaacgaagaaaagtgcatgatggaaagcctgctggcgttcaagcgcgccggcgccgacggcattctgacttatttcgcgatggacgccgcgcgtttgctgcgccagcgttgataatataaagcatggcgtccaccccctcgatcgcgctggcggcagggggtgtttgtttttgaggatgggaagatggatgtactgcatgccacatggttttgggtggcggtgatcgccgcgccggccatcgcgctgatcggcacgctggccaggctggcgcgcaaggagccgccgatcaagctgccgtccggcgtggcgccgctgcgttgggatgacgacgaggaagacgcgccgtccggcgaggccaagccgcccgtcgccggcaacggtgacagagtgccgccaaaacactgaaaactgtcactgctagccgcgtgacggctgggctagaatggcgacagtttatctcgcggcctgcctgtcgggcgggccgccgcgcagtccggctgcgggctaaggccccgcgtccggccaatcacaaggactgttatgaaccacacttaccttgcccacctgcaagccacgctggcgcagatccgggccgacggcttcgaaaaaccggaacgcgtgatcgccacgccgcaaagcgccggcatcgcgctggccggcggcgagaaggtgctgaacttctgcgccaacaactacctgggcctggccgacgacaagcggctggtgctggccgcgaaggccggcatggacgagtacggctacggctgcgcgtcggtgcgcttcatctgcggcacccagtccatccacaagcagctggaaaaatccatttccgaatttctgggcaccgacgacaccattctttactccagctgtttcgacgccaacggcggcgtgttcgaaaccctgctgagcgaagaggacgcggtgatctcggacgagctgaaccacgcctccatcatcgacggcgtgcgtctgtccaaggccaagcgcttccgctacaagaacaacgacatggccgatctggaagcgcagctgatcgccgccgaagcggccggcgcgcgcttcaagctgatcgtcaccgacggcgtgttctctatggacggcatcatcgccaacctcaaaggcctgtgcgaagtggccgaccgccacggcgccatcgtgatggtggatgactcccacgcggtgggcttcatcggcgaatccggcgccggcacgccggagctgtgcggcgtggccgaccgcgtcgacatctacaccggcacgctgggcaaggcgctgggcggcgcgtccggcggctacgtggccgcgcgccagcccatcgtcgacctgctgcgccagcgctcgcgcccctatctgttctccaacacgctggccccggccatcgccgccgccagcgtggaagtgctgagcatcctgaagagcggcgaaggcgccgaactgcgcgccaaggtgcgccgcaacgccgaattgttccgcaaggaaatggccgccgccggcttcacgctggtgccgggcgaacaccctatcgtgccggtgatgctgggcgacgcccgcctggctggcgagatggccgccaggctgctgaaggagggcgtttacgtgatcggcttctcctacccggtggtgcccaagggcaaggcgcgcatccgcacccagatgtccgcggcgcacagcgaagagcaggtgctgcgcgcggtggccgccttcatcaaggtgggccgcgagctgggcgtcatccccgattaatgcgtcaagcgccgcgccgcgtcaggcgcggcgggcaaggataagagaatcatgaaggcgttagccaaactgaaggccgctcccggcctggaaatgaccgatgtgccgatgccggaagtcggccacaacgatctgttgatcaagatcgtcaaaaccgcgatctgcggcaccgacatccacatctggaactgggacgaatggtcgcagaagaccatcccggtgccgatgcacgtcggccacgagtacgtcggcgtcgtcgccggcatgggttcggaagtgcagggcttcaagatcggccagcgcgtgtccggcgaaggccacatcacttgcggttactgccgcaactgccgcgccggccgccgccacctgtgccgcaacaccaccggcgtgggcgtgaaccgcgaaggcgcgttcgccgaatacctggtgatcccggccttcaacgccttcccgatcccggatgacatctccgacgatctggcctccatcttcgaccccttcggcaacgccgtgcacaccgcgctgagcttcaacctggtgggcgaggacgtgctgatcaccggcgccggcccgatcggcatcatggcggtggccatcgccaaacacgtcggcgcgcgccatgtcgtcatcaccgacgtcaacgactaccggctggaactggcgcagaagatgggcgccacccgcgccgtcaacgtcgccaagcaggacctgaaggaagtgatgcaggaactgggtatgaccgaaggcttcgatgtcggcctggaaatgtcaggcaacccgcaagccttccgccagatgctggaaaccatgaaccacggcggcaaggtggccttgctcggcatcccgccgtccaacaccgccatcgactggaaccaggtgattttcaagggcctggaaatcaagggcatctacggccgcgaaatgttcgagacctggtacaagatggtggccctgatccagtccggcctcgacatcagccccatcatcacccaccactacaaggtggacgatttcgaagccggcttcgcctccatgctgtccggccaaagcggcaaggtgatcctggactggagctgatccggctccccgcttcgccaggcaaacggctcccttgcgggagccgtttttgttggcggcggggtcagtcatgcggcggcgcgtcggcggcgcggcgggtcttgaagaaggccatcatctgcttcaggcgcagcgcctggctgttgagctgatcggcggtggacgacagctcttccgaggtggaggcgctcagctgcgtggtcatcgacagttggcacaccgcggtgttgatctgcatcagcccctcgctttgctctttcgacgccatggtgatttcctgcaccaggtcggcggtcttgcggatggagggcagcatctgccccagcagtccgccggcctgttcggccagtgccacgctgtccaccgccagcttgccgatgtcgcgcgcggcggtgcggcagtgctcggccagttttctcacctcggccgccaccacggtgaagcccttgccctgcttgccggcgtgggcggcttcgatggcggcgttcagcgccaacagattggtctggtaggcgatgtcgtcgatgatgtcgatctgccgggcgatctcccgtatcgccgacacggtctggcccaccgcctggctgccctggtcggcgtcctcggcggctttgcccgccatctcgttggtgatgccggcgttgtcggagttttgcgccacggtggcggcgatctcctccaccgacgcgctggtttcctccaggctggcggcctgctgcgacgcgctctggctaagcgcctgggccgaggccgagacttcttccgaggtcaggttcagcgattcggcgttgctccccagctcctcgatcacgccggtcagctggcgcaccatctgcgccatcgccgccagcacgctgatgtcgtcgccggggcgcggcgcgacccgcaccgtcaggtcgccggcagccacccgcttggcgatggcggccacctcggccggctcgccgcccacctggcggaacaggctgcggccgatatagatgatggcggcggccagcgccgccaggctcagcagcgcggcggcgatgaaccagccgcgctcgtcgcggtaatggctgcgcgattcggcgatctggtcccgcagcagtcgctcgaagccatcctggatggcggcgctggcgttaagcagctgctcggtcatgtcgcggtcctgcccctgcaccagccggtccacggtttggccggacaggcggtcgctctgccggaaggacgccagcgcggcgcggtagcggctatccagctggctgtgctgctgcaggatggcgttgagggctgagcggtcctggccgctgtctttttgcagctgggccgcctgttccagcgtctggtccaccgttcggccttcggcctggaaggcgttgaagtggcgctggtagtcggccggcgcgttgccgcgcagcaggatgtccttccattcctgcacctggatcttgaaatgcaaattggccaattgcacgctgcggttgatccggctttgctgggcgacatggttcaattgccgctccatgtcgcggttcatcgcggaaagctgatagatgccggcgacgaccagcagcaacagggtagacaggttgatcacgcccagcgcgacgagccgggttttcatgcggatttcatgcgccatctgcggatctcgtttgcagtcggattatctttgtattttgtatagtccgctttgcccgcggcggccggcgcttgaccgccatcaggggcggcgcgggcggcgcgtcggataatctgggccgagctatgcaaggggagagacgatgatcgcggtgataggcgccggcgtgtccggtttgtcatgcgcctggtggctgcgggcgcgtggcgcgccggtacgggtgtacgaggcagcgggccgggtgggcggcaaggtctggacccggaccgagggtgctttgtgcgaggccgggcccaatacgctgctggcggacgaggcgctgctgcgctggtttgaggagctaggcctgtcgccggtatggccggccggcggcggcaggccgcgccatgtgctgaaggatgggcgctaccacccgttgccgcagagcgtctcgcaatggctggcgggcggttttcccggttggtccgccaaactgggggtggcggcggggctgctgaaatccggcgatccgcgggcaggggaggaaagcctggcggcgttttgccgccgccagttcggccgcgcggcgctggataacttgctggacccgctggcgggcggcgtcttcgccggcgatccggatgagctgctgctggcggaaaccctgccagagctggcggtggcggcccaatcgccggggccgctgtggcgcgctttgctgcggctgcgcggccagcgtgcggcgcggcgggtctgcacgctggccggcggcctggaaagcttgccgcgtcgtctggcgcgcgatctggacatccggctgaacgcgccggcgacggcgctggcgcgcgacggctcgggctggcggctgcgcgccggggcggattgggagcgcttcgatcaagtggtgctggcgctgccggccggcgccgccgccgatttgctggaagggtcggaaccggcggcggcgacgctgtgccggcaggtgcgctacgcgccgctggcggtggcgttcacgctggcgcgcgccgaggcgctgacgcggccgctgccgggcttcggcggcctgcatccgcacagcgagggggcgttggcgctagggcatttgatgtccagcaatctctacccgcatgtctgccgtcccggcgagcggctgctgaccagcttcatcggcggccggcgccaggccgcgctgctggaactggacgacgatgcgctgctggcgcggctgaattgggaactggagcggctgttcggactaaagggggcaccgacgctgcagcgcgtcgcgcgctggccgcaggccttgccgcagggcacggcgatacagcgcgcgctgcgcgcggcgacggcgccgtgggccgagcggggcttgcatctgtgcgccaactggctggacggcgcgtcgctgccggattgcctggacaaggggcggcggctggcggcccgcatcgccggcgcggacggcacggctttgctccggcggcgctaggcggtagaatcgtcgtttacttcttcttctaccgccacgtttatgcttaccttccaggaaatcatcctcacgctccagcactactggaaccgccaaggctgcgcgctcttgcagccgtacgataccgaagtgggcgcgggcacctcgcataccgccaccttcctgcgcgcgctgggcccggagccttggaacgccgcttacgtgcagcccagccgccgccccaaggacggccgctacggcgaaaacccgaaccggctgttccagcatcaccagttccaggtggtgttgaagccggcgccggcgaatatccaggaactgtacctgggctcgctgaaggagttgggcctggaccccacccagcaggacatccgcttcgtcgaggacgactgggaaaacccgacgctgggcgcctggggcctgggctgggaagtgtggctgaacggcatggaagtgacgcagttcacctacttccagcaagtgggcggcctggattgcaagccggtgctgggcgagatcacttacggcctggaacgcctggcgatgtacttgcagggggtggaaaacgtctacgacctgatctggacccatctgccggacggccagcctgtcacctacggcaacgtgttctaccagaacgaagtggagcagtcccgctacgccttcgagcacagcaatgtcgaactgctgttccgccagttcagcgattacgaagccgaggccaaggcgctgctggaagccagcttgccgctgccggcctatgaaatgatcctgaaggcgggccacaccttcaacctgctggatgcccgcggctccatctcggtgaccgagcgcgccacctacatcggccgcatccgcacgctgtcgcgcggcgtggcgcaagcctattacgacgcccgcgaggcgctgggcttcccgatgtgccgcaaggactgacgaggttttgccggcattgcctatgctggtaaggccggcgcgggccgggtttgccggggagtggatgatgaaagcctgtattgcgatattgctgtgctgcagcctgccggcctgggccgagcagcctgccgactgggtggtgtaccaggacggcaagtcgctgcagctggcgatagacggcaactccctgtggctgggcaaggatggcctggtgcatttcatccaccaggaacgctttgccaggcaacgctacgaaaaatcgtaccggctgcacttttacatccgccgcaccaccggctacgccgattgcaagcagtaccaatacgtgtttgtcgggtcggaatatttcgatcagaacaacaagcacctgttttccacgatgttcccggtgccgcgctacgcctggaagtggcagccggtgaacgaggattcggtcgcccacgccatgatgaaggtgatttgcgaggcggccggcgccgcttcccaaaataattgaaacgatgacaatgaacgcaaccctgctgatagaactcctgaccgaggagctgccgcccaaggccctgccgcgcctggccgccagcttcgcccagaccatcaccgaagagctgaaaaagctgcagttcatcgccgccgacgccgaagcggtggcctacgcgtcgccgcgccgcctggcggtgcagctgccgcaagtgctggccatgcagcccgagcagcgcgtcacccgccaggggccggcggtggccgccggcatgaaggacggtcagccgactccggcgctggccggcttcgcccgctcctgcggcgtggaagtgtccgagctggccgtggtcagcaacggcaagcaggatgtctacgcttattccagcaccaaggccggcgaggcgctgtccgcgctgctgtccgacgtggtggcgctggcgttgaaaaagctgccggcccccaagctgatgcgctggggcaatctggacgtgcagttcgtgcgcccggtgcacggcctggtgatgctgcacggcgacgccgtggtcgatggcgaagtgctgggcctgaagagcggccgcgttacccgcggccatcgtttcctgtcgcagggcgaggtcagcatcgccgacgccgatggctacgcccgcgccatgcatgaagaaggcaaggtgatcgccagcttcgccgcccgccgcgaattgatcggccacaagctggccgaggccgccgccaaactgggcgccaccatcgccgcgccggatgcgctgttcgacgaagtgaccggcctggtggaatggccggtggtgatggaagccggcttcgaggccgaattcctgcaagtgccgcaggaatgcctgatcctcaccatgcagcagaaccagaaatacttcccgctgctggaccagaacggcaagctgatgaaccgcttcttgctggtgtccaacatcgcgccgcaggatccgtccttcgtcatcggcggcaacgagcgcgtgctgcgcgcccgcctgtccgacgccaagttcttcttcgagcaagaccagaaggtccgcctggacagccgcctgccgcgcctggccaatgtggtgtaccacaacaagataggctcgcaactggagcgcgtggagcgcctgcagagcatcgccggcgccatcgcccatgaactgggggccgacgccgcgctggccgcccgcgccgcttacctggccaaggccgacctggtgtccgacatggtgggcgaattccccgagctgcagggcatcatgggcatgtactacgcccgccatgacggcgagcacgcggaagtggccgccgccatcgaaggccactaccacccgcgcttcgccggcgacacgctgccggaaggcaagatcgccaccgcggtggcgctggccgacaagctggaaaccatcatcggcatctggggcataggcctgatcccgaccggcgacaaggacccgttcgcgctgcgccgcgccgcgctgggcgtggtgcggatggcgctggaggcagacctggacctgaagcgcctgctggatatcgtggccaacgccttcccgaccggcaagctgtccgccggcgtggccgacgaagtgttcggcttcatgatggaccgcctgaagaacttcctggccgccgactgcaaggccgacgagatcgacgctgtgctggcgttgtcgcccagccgcctgtccgaggtgcgcgcggtgctggccgccgtggcccagttcaaggcgctgccggaggccgccgcgctggccgccgccaacaagcgggtgaagaacatcctgaagaaggccgagggcgacatcgccgcggtgaacccggcgctgttcgccgaagacgccgagcgcgcgctgttcgacgcggtggagaccctggcgccggcggtggacgccaagttcgccgcccacgacttcgccgccgcgctggcgcagctgtccagcctgaaggcgccggtcgacgccttcttcgacggcgtgatggtgatggcggaggacgccgcggtgcgcgccaaccgcatcgcgctgctggcgcgcctggccgcgctgttcaaccgcgtggcggacatctcgctgctggcggagtaagggcagggcggaagcccggcctggccgggcttccgccaaactttcagcttgcgatagcctgaatggcggaaggccccggcggggcttccgccctactcattgggggacgcgtgaaactagtcattctcgaccgcgacggcgtgatcaacgaagaccgcgacgatttcgtgaagaacagcgtggaatgggtgccgatcgagcacagcctggaagccatcgccaacctgacccagtcgggctggcgcgtggtggtggccaccaaccagtccggcatcgcccgcggcctgttcgacgtgcacgcgctcaacgcgatgcacgagaagatgcaccggctggtgaaccaggccggcggccgcatcgacgcggtggtgttctgtccgcacgggccggaccacggctgcgaatgccgcaagccgctgccgggcatggtgctggagatcgccgagcgcttcaatgtcaagctggaaggcttgccgctggtgggcgacagcctgcgcgacctggaggccgtcgcagcggtgggcggccagcccatcctggtgaagaccggcaagggcgccaagacgatggcgtccggcaagctgccggaaagcaccctggtgttcaacgacctgtacgatgccgccgagcatctgatcaaccatcactgaggtagacactgcaagcatgatcagtctatggatacgcaatctgctgtactggctggtgctgtgcgtcatcacgccgctgtttttctgcctgctgctattggcggcgccgctgccgcgccgcggccgccatgtgttcggcgtcagctgggcgttgaccctgctgtggatgcttgagcacgtcatcggcctgaagtacacggtggtcggccgcgaaaacatcccggacgagccgtcggtgatctgctccaagcaccagtccggctgggagacgctggcgctgcagaagatctttccgtggcaggtgtacgtggccaaacgcgagctggcctggattccgctcttcggctgggggctggtgctgatgaatcccatcatgatcaaccgctccgaccgttcccgctccaaccagcgcttgctggagcaggggctggagcgcaagcgccacaagttctggatcacggtgttccccgagggcacccgcaccaagccgggcgtgccgggcaaatacaagctgggcgcggcgcggatggccaagcagttcgacatgccgctggtgccggtggcccacaatgccggcgaattctggccgcgcaacgccttcctcaagtatccgggcgaagtcaccgtggtgatcggcccggcggtgcgtccggccgatgacgccggtccggaggcgatgatggccgaggcggaagcctggatagaatcgcagcagcgcctgatcggcggcgtcggccccttcgcccatcccgatgaaaaacgccagcgtctggcaccgcctgcctctgcctgacggcgaggtgccggtgctgctcacccgccgcgcgcgcaagagcataggcatcaaggtgcacggcggcgtggtggagctgatcgccgcgcccggcgtcagccagcagcggctgcaccaggtgctggagctgcgccgcgactggatagtcggccacgtgctgcgccagcgcagccagctggctgccggcgccgagctcactcacctgactctgctgggccagccgctgccgctgcaactggccggcggcctgcgcaaaacggcgcgccgcagcggcgacgcgctgctggtgggcggggtggccgccggcgaccgcgacggcctgaaggcggtggtggccaaattcctgaaacgcgaggcggctacgctgtttcccggccgcctggccttgctggcggcgcgctgttcgcgccagccgtccagcctgcagctgtcgtccgcccgcacccgctggggcagctgcagcgccgatgggcggatccggctgaactggcgcctgatgcaggcgccgctggcggtggtggactatgtgatcgcccatgagttggcccacttgctgcacatgaaccattccccggcgttctgggccgagaccgagcgtctgtgccccggctggcgcgatgcacgccgctggctgcgccaatatggcggcgccttgtttgcttttgattgaatcatttaggagattgattatgcgaatgctccataccatgctgcgcgtggggaaccttgagcgctctttgtcgttctatcaggaagtgctgggcatgaaactgctgcgccgttccgattttccggaagggcgcttcacgctggccttcgtcggctacggcgacgaggccgaccataccgtgctggaactgacgcacaactgggacaccgcatcctacgagctgggcaatgcctacggccatatcgccatcgaagtggacgacgcctacgccgcctgtgacatggcgcgcgccaagggcggcaaggtgacgcgcgaagccggcccgatgaagcacggcagcaccgtgatcgccttcatcgaggacccggacggctacaagatcgagttcatccagaagggcagccgctaagcccaggcgccgtccgcggcgcatccggccaggcgggcacccggagtctgcctgcgccgctcactacaaccgggaacgttctggcagcatctcgctgcattttttgctcttgggcgcatgcccgcaggaaggactgatgaatcataaattacttggcatggcggccttgtccatgacgcccgcgctcgcgcaggccgccgatatggacggggccgcgatgggcttggcctggggcgtgccgtttgccggcatcctgttgtcgatcgccctgtttccgatgctggcgcccggcatctggcatcatcatttcggcaagatcaccgccgcctggaccgcgctgttcctggcgccgttcgccgtgtccttcggcctggggcacgccgccacgctggtgctgcacgcgctgctaaccgaatacattcccttcatcgtgctgctgttcgcgctgtacaccgtgtccggcggcatcctggtgtggggatcgctgcacggctcgccgcggctgaacaccgcgctgctggcgataggcacctgtctggcctccatcatgggcaccaccggcgcggcgatgctgctgatccgccccttgctcaaggccaacgagggccgcaagcgcaatgtgcacgtggtggtgttcttcattttcctggtggccaatgtcggcggcggcctgactccgctgggcgacccgccgctgttcctcggctttctcaagggcgtgaccttcggctggaccttccagcacatgctggcgccggtggcgaccctggccgcgctgttgctggcgatattctatttcctcgaccgccatctgtacgccaaggaagcgcaggagggcacgctcaagccggtggacgccagccacgacaagccgctgaagctgtacggcaagcgcaatttctggctgctggccggcgtggtgggcgcggtgctgatgtccggcctgtggcagcccggcatcgtcttcgagctgcccggcgcccacctggagctgcagaatctgctgcgcgacgccgccttgctgctgctggcgctggcctcgctgtggatcacgcccaagcaggtgcgggccggcaacgagttcaactggctgcccatcctggaagtgggcaagctgttcgccggcatcttcatcaccatcgtgccggtgatcgccatcctgcgcgccggcgcgcacggcgacctggccggcctggtgcagatggtgtcggcgccggacggcaagccgctggacggcatgtacttctggatgaccggcatcctgtccagcttcctggacaacgcgccgacctacctggtgttcttcaacctggcctccggcgacgccgccacgctgatggggccgttgggcagcacgctgctggccatttcgatgggcgcggtgttcatgggcgccaacacctatatcggcaacgcgcccaacttcatggtgaaggccatcgccgagcaccgccatgtcaagatgccgggcttcttcggctacatgctgtggtcgggcgccatcctgatgccttgcttcgtgctgatgacctggctgttcttctgagcgcggttcttggcgcaaaaaaagcccgcggcgcgccgcgggcttttttcatgccggccgctggcttatttggccggcgcggctggggtgagcaccatcacttcttcctgcggcgcggcgtacgtcggctggcgggcgtcggcgtagccgccgttgtcgcgcatggttcccagcgcgccgaattgctcggtgatctgttcgaccacgttatggcccagcgacttggacacttcggacacgatcttgccgttgttggggttgaggacggcgccttgctcgccgaccagcttgacgtcggagccggctcccatcgcgctgaacgccgccttcaccgcgtaggtcttggtgtttaccaggctgaagtccgccaccagctgcatattgcgcgacaaggacaccgtggaggtgccggcgatggggttggcgtcgtcctgcacgtcgatgttggagacggtgccgaacagcacgtaatcggcgccgcggaactcgccgcgcttgatgcgggcgatcacgtcgaacagcgtttcgttgttcttggagggccgatagccctgggcttccaccagctgcacggtgcgcagcttcagcagctcgcccttgatgtcggcgttgaagcggcgcatttcgccgcggtcgatgcggaccttggtgccttccacttccagatagcggttgctgctggaggcggcggcgtagttgcggttggcgttgaagctgtcgtcgctggaggcggcggtcaggtggaagtattcttccactttttcttcgtaggcgagattggcgacggtgattttgagggcggcggcgccggccagcgtcggcagcacgaggagggccgcggccaggcttttcaataagatttttggcatggaaatgtcagtctgcagaaggccgggcttccgtgggaggcccggccggaaaacaaggatcagcggcgggaggtcttgcggatttcctgctcgtcggcccataccagctcgccggtttcgttgtccaccagctccaggctgagcttgtagtacacgtccttgacgtcgctgttcttcttgacgatggaggagatgccgccggtcaggcggtagtcggcgccgaccatcttgcctatcttcttgctcttgctcttgtcgtacaggccggactggttctggcgcatcaattcctgggtctggccttccatgtgggccacgtcggcgacgaagcgcacggtgccggccttcatcagctgcacgcggatcgatttggtgatttcggcggtgtcgatgtattcgctggtcttgttctgcacgtcggccagggtcaggcgcttgccgcggatgaccggcacctgcaccagcgagcgggtcatgctttccgccaggcgctgcaggtcggtggagccgaattcattgctgaccagttccaccgccttgctgtcgccgtagctgacggagccgtcgcccagcgtcggcgagttggtctgggcgcagccggacagggcggcgatggcgagggcgcacagggcggagcgggtcagattgcgggcattcatcatgggtatccttgacttgcggaattaacggaaaagattgacggagttgtcggggctctgcagttccaggcggaagtcggcggcctgcggcgtgggggcgacggtctggatggatttgcgctccaggccctggagctgcagctgcttccaggtttcctcggcgccggtttgcatgccgctgccatccagccatttgaagcggtagaacagcatctgctgcttggtggcgctgttggacagctcggcctggacgttgaggaagtcgttgcgcttgacgacgcgtgcggactccaccttgatgttgtccattttccccagcgtttccagtttgctttccagcccgtcggcatggcagagcggggccgcggccagcgcggccaggagcagacaacgacggatgtgacgcatgttcatggtgttcctgaattaaatgccggcggttttcactgcggctgccggcggttgcttgccgccttggggcgggatgacggtttgttcgaacaggcgcagcggcacgatggcgtggctgccggagatatccagctcgacctggcgttcgccgctcggggtgggcacgctgacgctgtagcggcccggcttgaggttgacgcggccgatggcgatgcgggcgggcagggtgctccaggcgcgctcgtcggattgctcggtcagcacggtggcggtgatgccagcgagcgaacccagcgcgccgaactggtcgcccagctctttctgcgccagccctttggcgacggcgcgcacggtgctgcgcatgatgatgccgggcatctcgtcgcgcagcgcgcggcgggccatggcgtcgaaattgctgatcggcgtcagcgcgaccggcttgtctcccacctgcaaggccagcggctggtagctgtggccgggcatgatcaccgggaaggcgatctgggtgatgatgggcttgccgtccaggctgaacggcatcggaatggccagcgaggtgcgggtggggatcagcccgctttccaccacgaacaagacgtcggtgccagcggctttctgggcgatgcggctgttcaggcctttcaggccttgctccagcagcggcatgttggggcgcagctcgatggctttgcggtagccggcggaggcgagggagggctcgcgcagcgactcgaagatgtagccggcgaggtagtggctgaaggcgctctgataaccgttcttcaggttcaggacttccgggtcgtccagggtttcgaccggatagccttgcagatccttgaaggtggtctggacgttgttctctttcgcctcctcttccaccttgtcgtactctttttcgtgcaggctggcgatcagcgcttcgcgctcgtaggttttcttgatttcggtgcgggcgccggcgtagttgccggacagcgcgtgatccagcgtcagcatggtgctgagcatcactttctcatagtcttcgccgtcgtagcgccggaccttgtcgttgatcagcaggctgccggcggtttccgccgccttggatgtggtgagcttggattcctcttcccagacgcggatcttttcatccgccttcagccaggcgtccacgctgccttgcagatcgcccttcagccgcagcaactgccccttctccaggtgatagagcaggtctttgtcttcgctgctgttgttggcctcgacgctggccagcgcatcgtcgatgcggccttcgttggcggcggccagagcggttttcatttcgccttgatagctgcgcatcgagccgcaggcgctgagcgaggcggccaggccgatgatgagcacggaattggccagtttggatttgcgtttcatcttgtctttggctgttgttttcgagagggaagatcggcggtcgacccggcaagaaaggcggttgcggcggcgaggagagggtttcagacgcggaattgccggatatcaggcaggcggcgaagcttgcgctccagagtatttgtcgcagaggtgactttatttgccaggatagttcaaaaattaataatgttaattgttaataatttttaagtcaaaaagaatattcttacgtcctgccgagagcaggctggcggcgcggcgttttcgcggcatggcgtttcagctatcctagcaactttgtcctgaacgccttactgaccgacaccatgcacatccacatcctgggtatctgcggtaccttcatgggcggcatcgccgccatcgccaaacaggccggccacaaggtgaccggctgcgacgccaacgtctacccgccgatgagcacccagctggaggagatgggcatagccctgacccaaggcttcggcgcggagcagatcgaactgaacccggacgtgtacgtgatcggcaacgtggtgacgcgcggcaagcccttgatggaggaaatcctcaatcgcggcttgccttacatctccggcccgcaatggctggcggagaacgtgctgcaggacaaatgggtgctggcggtggccggcactcacggcaagaccaccaccagctccatgctggcgtggatactggaagacgccggcctggctccgggctttttgatcggcggcatcccggagaatttcggcgtgtcggcgcgcttgccgggcaagccggcgctggatccggccagcgtcagcccctttttcgtgatcgaggccgacgagtacgacaccgccttcttcgacaagcgctccaagttcgtccattaccggccgcgcaccgccatcctgaacaatctggaattcgaccacgccgacattttcgccgacctggccgcgatcgaaacccaattccaccacctggtgcgcaccattcccggcaacggccgcatcgtcagcaacggccgcgaggccaatctggagcgcgtgctggagcgcggctgctggacgccggtggagcgcttcggcgcggacgccggttggcagctgggcgagctgcatgaggacggcggtttcgatgtgctgcttaacggccagatgcagggcacggtgcgttggggactaatgggcgagcacaaccgcctgaacgccgtcgccgccatcgccgccgcccgccatgccggcgtggcggtgaaagatgcgatagacgccttgtcgcgtttcgccaacgtcaagcgccggatggaagtgaagggcgtggcgggcggtgtaaccgtttacgacgacttcgcccaccatccgaccgccatcgccaccacgctggaaggcctgcgccgcaaggtgggccaggcgcgcatcctggcggtgctggagccgcgctccaacaccatgaagctgggcacgatgaaagacgcgctgccgggttcgctggcgctggccgaccaggtgttctgctcggctgcgggcctcaactggaatccgggcgaggcgctggaggcgatgggcgccaaggcgcaaaccttcaccgacttcgatgcgctgatcgacgccatcgtcgccgcggcccggccgggcgaccatgtgctggtgatgagcaacggcggtttcggcggcatccaccagaagctgctggaccggctggcctaagccatcttcacgtaaaaaaaaccgcccgggcgacgccgccgggcggtttttttgcgcgcgccgccgttcagggcagcttgatgatgtagttggcgccgccttcgcgcgcttttccctgcgcctgctgcagccgctccagcatcggggcggggctggtttcggtcgggcgcagcgcgctcaggccgacgcaggccgcggcctggtgttccgcgccctgatagacgaaggtgagctggcgcaacgacttgatcagccgccggcccatttcattggcgccgctcatcggcgtgttgggcagcaggatgatgaaggcgttggcgctgcggcgcgccaccaggtcgctgtcgcgggcgttttgcaggcacaggctgccggccagtcggatcagatgggcgtaggccgaaccgtcgtcctggtcgggcaccatttccggcgcgttgaccagttccagcgtcaagcccgacagcgggccgccatagcggcgggcgcggctggtttcggcgttggcgacggccagcagccggtgcatgccggcgacgccggtcagcttgtcctcgtcgtcggtttggccgccttcttccttcagtgtcttgacaatgctcagcgagcgctccaccagctggcgttcaaagtccagcagctgccccatcaccttggcctcggtgcggtcggaaaagctgaataccagcatcgggcggtcgttgaggctcaccttgcgcaccgacagctgcgcttcgaaatcgcggccgctggcggtgcgcagctgcatgccgcggttgtagatcatgttgtcgctgcccagctcggcgcggatgccggctgccagttccggatcctggatgaagtcgaagatggagcggtccagcagttcgtcgtggggacaggcgagcaggatgcaggccaactggttggcggatgcgatgcggccatcgtccggagacgccacgatcaggcaaccctggacggtgtcgatgaaaggctggagcgcctggaacgtaaccatgacttcaactcctgtggcggacgaggagggtttttcgcgcagggcgcccgttgggcattacgtgcttttacttaatcttattcctagttggcacagatttcacggtcaggtgttcatgctgaatggaaattttccatgtcgttcgggtaatgtgccaaggtcgggccttaatttggtagataccacccgcaatcgtgttacattttgaaacgtatcgcaggatctgcgatgaggaccggcgcgtttcgccaccccagaaacgccggtagccgccgttgaaccgacggcctcctctcccggctccgtcttcccgagtccctgcctgccggcaacgcgccgcgggaggagaggacgccatcagacatccgcgccaggctgcaaaccggccgggacggatatcggcacccaagcttttcccgctcggacggaacgcgttttcgcgcgccgcgggcgcggcatgcgctttcaaaaaaccaatacgacaaagaagtgacaggacatggctagatctcaatggggctcgcgcctcggtttcattctcgcggcggccggctccgccatcgggctgggcgccatctggaagtttccctacgtggccgccaccaacggcggcggcgcgtttttgttcatctacctcggcatctgcctgacgctggggctggtgctgatgctggcggaaatggcgctgggacgcgccaccggcgccggcgcggtcggcgctttccgcaaggtggccggcggcttctggccggtgatcggctatatgggcgtgctggtgtgctttttgattttgtcgttctacagcgtggtaggcggttggaccatcgcctacatcgtcaagtcgctgcagggcggcatcatgacatccgaccccaaggcgctaggcgccattttcaacggcttcatcagcgatccggcgcagccgctgctgtatcacggcggcttcgcgctgctgacgctggcggtggtggccggcggcgtgcagaagggcatcgaggcgctgtccaagctgctgatgccggcgctgttcgcgctgatgctggtgctgatcgcgcgcgggctgacgctgccgggcgcgctggagggcgtcggctacttcgtcgcgccggacttctccaaggcgagcgccgccatgctggtggacgcgctggggctggccttcttctcgctgtcgctgggcctgggcatcatgatcacctacggctcctatgtcggccgcgaatccaagctgctgggttcggcgctgtgggtgatcctgctgacggtggcgacctgcttcctggccggcctgatggtgctgccggcggtgttcgccttcggcttcgacccgtccgccggtcccggcctcactttcatcaccatgccggcggtgttcgcccacctgccgctggggcaattgttcgcggtgctgttcttctgcctgctgctgctggcggcgctgacgtcctccgtttcgctgctggaggtggtgaccagcttcgccatcgacgaatggggcatgtcgcgccgcgccgccgcctggctgatggccgccggcatcttcctgctgggcattccggcttcgctgtcgctgggcgtgtggggcgattaccagctgggcgggatgaatttcttcgatctgctggatttcgtcacctccaagctgctgatgccggccggagaattgttgctggcgctgttcgtcggctggaaggcctggccggtggtgaaggccgagctgtcgtccggccgctcgccgcgggcgatgcagtgcatgcgcggcttctgcatggcgctggcgccgctgctgataggctggatcatggcggctggcatctaagcggataggtggaaaagggacaacgggaggcgcgagcctcccgttttgctatggttcagactgtgcgaacccggcggagcggcgaaatgcggtggatggggctgttgctgttcggcctgctggccggcgcgcctcgcgcggaaacattgcaggtgctgaccacccagattcccggggtgatcgcgctggcggccgacggcgtcaccatggagggcaccggcatcgacctgatgcgcgaggtggggcgccgcgccggcgtcgatttccgcttcgccgcctatccgcaggcgcgggcccggctgctggtggagcagcaggtcgacgcctgctcgccgatggcgcggctgccggaactgggcgagcgttacaagtggaccgccacgctgctgccgatgcggctggtgctgctggcgcgcgatggtgacgcccgccggctgcgcagcctggatgaggcgcgcggtttgcggataggcgcgatgcgcggcaccatggcggcggcgcggctgagggcgcgcgggctggcgccggaggagagcgccgattatttcggcgggctggagaagctgcaattgggccggctggacctgtgggcgatgctggacgtcggcgtggcgtcgctggcgcggcggctgggcatgccgcagccgcgggtggcgctggtgctggacacgctggatgtggccttggcctgcaaccgcaagctggatgacgcggtgctggcgcgcttggaccgcgccatcgcctccatgcatcaggacggcagcatcaatcatttcgacctgcgttgagccggcgcatgccaaacgcgcccgggctgggctacactgccgctttgcccgttttgcgagaccgccttgaaagtccgtctgacactgttatccggctgcctgctgctggccgcttgcgccacgccgccgaatcccgcctccgctcccgctcccatcgtcgcgccggttccggaagagccggcctccgcgccggcggtggaaacactgccgcaaacgccgccgccggcctcggcgccagtgcaggtgccgtcgctgcccatcgcccggccggtgcagccgcccgccgtcatttccgacagccagggccgcgctttgctggaccggctgctgccgccgggcatccccgaccgcaagggctggagcaatgacgtgatgggcgcgttcagccatctgaagattccgtacacgccgcagttcttctgcgcggtgctggcggtggcggagcaggagtccggcttcagctccgatccggtggtgccgaatctgtccaagatcgtttggggcgagattgaccagcgccggcagaaatacctgataccgtctttcgtggtggacgcggcgatgagcaagaaatcgcccgacggccgtacctacaagcagcgggtggacgcgctgcgcaccaagcgcgaaatgaacgcgctgtatgaagacatggtgcgcgagctgccgttcggccagaccatcttcgagcacaagaacccgatccgcgacggcgggccgatgcaggtcagcgtcgccttcgccgaaacccacgtccgcgcctggccgtatccgtacaactattccagcctgcgcgacgaagtgttcacccgccgcggcagcgtctacttcggcaccgccatcctgctgcaatacccggcgccgtatcatgaaatggtgtaccgtttcgccgactacaacgccggccgctacgccagccgcaacgccgccttccagcaggcggtggcccgcctgtccggccgcaagctggcgctggacggcgacatcatgctgtattccgacaagatgaaccgcgtgctgtccggcgcggtcagcgacacccagcgcgcgctgcagtccatcgccggccggctggggatgagcaatgcggaaatgcagcgcgatctgcagcaggagaagctgtccggcttcggccagagccagctgtaccagaaggtgttcgcgctggccggccccaaggccccgcgcgagatcattccgcagatcgtgctggtcagccccaagttcacccacaagctcaccaccgagtggttcgcgcgccgcgtcgacggccgctaccagcgctgcctgcagcggggaggctgagccccgccggcttgagtccgcaccgatagcgcctatagtgattgcagcggcgccgcggcgggaaaccgcgcggcgccggttcgcatccggacggcggccgtttcctggccgtcgtctcgcgtttttcggaacgggaggcaggcatgaaggtttccatcaacggcaaggaggtggagctgggctcctctccggacacgcccatcctgtgggcattgcgcgacgaactgggcctgaccggcaccaagttcggctgcggcgcggcgctgtgcggcgcctgtacggtgctgaagaatggcctggcgatacgcgcctgcgtgacgcccatctccacgctggccgccgatgacagcatcaccaccatagaaggcaacgccggcaaggtggcgcaggcggtgaagcaggcctggcacgatctggacgtggtgcaatgcggcttctgccagagcggccaggtgctggccgccaccgccttgctcagcgccaacccccatcccagcgaccgcgacatcgacctggccctcagcggcaatctgtgccgctgcggcacctatccccgcatccgcgcggcgatccacgccgccgccaaactgttataggaggccgagatgagcgtaagcggaatctcccgccgcgcctttctcaaggccggcggcatggtgggcggcgccttgtgcctgggtttcgtgctgccgaacggcgggctggcgcgggcggccggcgcgggcggcgccatcccgacgccgaatgccttcgtccgcatcgagaaggacggcggcgtcaccatcgtcagcaacaagtcggaaatggggcagggcatctacacctcgctggcgatgctgatcgccgaggagctggagtgcgactggagccggatccaggtggtgtcggcgccggcggcgcccatctacgtccataccgccttccatatccagatcaccggcggcagcaccagcacgctgtccagctacgaccagtaccgcaagataggcgccgccgcgcgcgacatgctgatagccgccgccgcccagcgctggcgcgtgcctgccgcgcaatgccgcgccgaaaacagccgggtgttcaataacgccaacggcgccagcctgggctacggcgagctgaccgaggccgccggcaagctgccggtgccggacacggtggcgctgaagccgcgccatcgctggaagctgctgggcacccgcgtgcatcgggtggacggcggcgagaagctggacggccgcgcgcagttcgcgatggatgtccgcctgcccggcatgctgacggcgctggtcaagcgctgccccagctacggcggcaagcccaagggcttcaatgccgacgcggccagggcggtgcccggcgtcaaggccgtgttcgcgatcagcaacggcgtcgcggtgctggccgatggcttctggccggccaagaaggcgcgcgacctgctggaagttgagtgggaccgcggcgccaacgccagcctggattcggcccggctgcgcgcccactaccgcgaactggcgtcgcggcccggccagcattaccgcggcgtcggcgacgccgattccgcattggccggcgcggccaagcaactggaggcctggtacgaggcgccgtatctgtcgcattcgccgatggagccgctcaattgcgtggtctggctgaagccgggcagctgcgaaatctggagcggcacccagtcgcagaccatagacgccggcatggcggcggcgatgaccgggctgaagccggagcaggtttcgctgcataccacctttcttggcggcggtttcggccggcgcgcggtgccggtgggatccgattggctgagagaggcgctggaagtggccaagcaacatggtcaggatctgccggtgcggctgatgtggacccgcgacgacgatctggccggcgcctattaccggccgatgtggctggaccgcgtgcgcggcggcatagccgcggacggcaagccggccgcctggctgcagaccggcgtcggccagtccattctggccggcacgccgttcgcgccgatgatggtgaagaacggcatcgacgcggtatcggtggagggcaccgacgacatgccctacgcgctgccggcgctggcgctggacctgcatacgccggagattccgctgccggtgctgtggtggcgctcggtcggccattcgcacagcgccttcgccaaggaaagcttcatcgacgagctggcgcggctggcgcgccgcgacccggtggcctaccggctggcgctgatggacaaggcgccgcgcgagcaggcggtgctgcgcgaggcggcgcggatggccggctggggccgcaagctgcccaagggccacggcctgggggcggcggtgcatgcctccttcggcagccatgttgcccaggtggtggaggtggcggtgaagggcaaggaattgaaagtgctgcatgtctggtgcgcggtggattgcggggttgtggtcaatcccgaccaggtggccgcgcagatggagggcggcatcatgttcggcctgtcggcggcgctgttcggcgcaatcaccttcaaggacggcgaagtcgagcagaaaaacttcgacggctaccagatcgtcaggatgttccaggcgccgaaggtggatgtctccatcgtcgccagcgacgaagcgccgggcggcaccggcgagccggcggtgccgctggtggcgccggcgctggccaacgccgtccacgcggcgtcgggcaagcggcggcgcgagctgccgctgatccgccacggctatcagatggtatgaggaggcggccatgagaaaaaccatgatcctgggctgggcgctggcggccgctttgccggcagcctgggcgggcggcgacccgtcggcgtcgctgcgggcctatggcgaagtggccaaggtgctgcagtcgccgcgctgcatgaactgccacaccgtcaccgactttccgcgccagggcgacgaccgccatccgcacgcgcagctgatccggcgcgggccggacaatatgggcgcgccgtcgctgatgtgcatggcctgccaccaggcggccaactccgccgacggcctggtgccgggcgcgcccaactggcatctggcgccgctggcgatgggctgggaaggcctgagcggcgggcagatctgccggcggctgctggacaagacgcgcaacggcaaccgcgacgttccggcgctggtggcgcacatgaccgccgatccgctggtgcaatgggcatggaagcccggcgccggccgcgcgacgccgcccctgtcgcagcaggacttccatgcggcggtgcggcgttgggcggacagcggcgcttattgcccgcgctgaggccgccatgcaaggcaatgtcgaggaagtgctgagccaggcgctgtcctggctggagtccggccggcgcgccgctttggtgacggtgctgtccaccttcggcggcagccccaggccgccgggggcgatggcgctgatccgcgacgacggcgcggtgttcggctcggtgtccggcggctgcgtcgaggatgacctggggcgggagatcgtcgccggcggctttttcggccgggagacggcggtgcgggtgcgcagcttcggcgtcagcgtcgaggagcgccagcgctaccggctgccctgcggcaacagcctgcgggtggcggtggagccggcgccggacgcgggccagctgcgcctgttgctggacgcggtgcgcgcgcagcgctgcctgtggcggacggtgcgctaccgcgacggcgcggcagcgttgtccgacgccggcccgccgggcgagttcgccgaggacgaacaaggcttcggcgtgttgcacggaccgcgctggcggctgctgatcatcggcgcgtcggagctgggcgcctatctggcgcagatcgcggtgacgctggattacgcggtgacggtgtgcgatccgcgcagcgaatacagccaaggctggagcctgtccggcgcgcgtctgtccggcgagatgccggacgacctggtgctggctttcggctgcgacagccgcaccgcggtggtggcggtcacgcatgatcccaagctggatgacctggcgttgatggaggcgctcaggctgccctgccattacgtcggcgcgctgggttctgccgccaccaccctgaagcgcaaggcgcggctggccgagcacttcggcctgtcgccggcgcagctggagcggctgcacggcccggtggggctggctataggctcgcgcacgccggccgagatcgccgtctccatcgccgccgacctgatcgccagccgcagcgagcgcgcgcggccgggcgtcgccggcgcggcgcggacttgccgcgcatgatagccggggccatgctggcggccggagcggggcggcgcttcggcggcgacaagcggcaggccgcgctgccggatggccgcacgctgctggaagccagcctgcaggctttcgtcggccaggtggacgtattggcggtggcgctgccggaggacgacgccttcggcgccgcgctgtgccgccagttgggcgcgacgccgctggcctgccggctcaatcgcgccggccttggccattcgctggcctgcgccgccgcctgggcgctggcgctgccgcaatgccgcggcctggtgctgggcctggcggacatgccgctggtgcggccgcacaccgtcagccaggtggcggcggcgctgtggcacggccggccggtgctgccctgctacctgggccaggccggccatccgcgcggcctgcccggcgcgtgcctgccggctttgctcgatctgtccggagacatcggcgcgcgcgacgcgctggactggagccaggcgttgcggctggagctggacgacgccggcgtgctgctggatatcgatacgccggaggatctgctccggctgggctgatccgcgcggtttggcgcgcgccgcgccgtctttcctatagtgaagtgttcttgcgcgtcgggggtgagcatgcgagtgcgctttacggttgcccacaagctggtgttgctgatcgcgccgctggtgctggccttgtttttcgtggcgatcggctatgcctggaaccagcgccagctgctgcaggcgctgaatcgcgaccagacgctgacggaaaacatcgcgatggtcggcgagctgatccagtcgctgcaggacgagcgcggcttgagctacggctacctgaaccggcaccaggccttgccggcgcagctgggacgggcgcgcgacggggcctccgccgccttgcagaagctgctgcgccagccgcaggcagagctgtctgatgcgctgcgccattacctggaaaccagcgcgccgcggccggaacaactggcgcagctgcggcgcgatgtcgacaaccgccatatttcgcccgaccccgccttcaaccgctattccgacatgatcgagcagctgtcccgcatcatcaccctgttcaacgcccagacccaggacgtacaggcgctgatcttgcagtggtcggcggtgaattgccagaaggagtacaccggccgcacccgcgggctgatcaccggcgtgctgacggtgggcagcttcaccatcaccaatttccgccaggtgagcggggtggtgtcgcaggaagaactgtgccggacgcaatatcggcagtacggcggcgacgacgcgctgctgcgcaacgccatgatgcgcagccgccagttcgagtcggcgcgcgacgcggtgctggcgcgcggcgccggcgcgatgcagagcgcgacgccggaggagtggttcgccgcggccagccagcgggtggcgtcgctgtaccaggtgcagcaggacctgctgcagcagatccggcagcgggtggagggccaggcgcatagcgcgcgcctgcatggctatctggtgctgctgggtctgctgttcctgttgctgcccatcgcgctggcagtgctggtggggcgcaacatcatccgcacgctgggcgccgagcccgacgaggtggcgcagggcatgcgcgaattgtcggccgggcggctggatttctttctgccgctggcggccggcgacgaccacagcctggccgcgcacatccgccagatgggcgaccggctgtcgggggtgatcctgcaggtgaagcaggacgcggatgcggtggccaacgcgtccaccgagctgaattcggcttcgcagggcttgtcgcagggcgcggcgcgcgcgtcggtcgacgtggagggcgccagcagcgcggtggacgagatcgcgcgcagcatggccgagatggccggcgacgccaaccgggccggcggcatggccgataccgcgaccgggcaggcggcggacggcaaccaggtggtgcagcagaccatcgcggcgatgcgggagatcgcgcgccgcaccaccatcatcgacgacattgcctaccagaccaatctattggcgctgaacgcggcgatagaggcggcgcgggccggcgagcacggcaggggcttcgcggtggtggccgacgaggtgcgcaagctggcgaagcgcagccaggcggcggccaaggagatcgaccaggtggcgaaccgcagcgtgcagctggcggagagcgccggccggcagctgagcgacatcgtcgactccagccagcggacgctggaattggtgcgcggcatctcgcaggaagccacggtgcagtcgcagcgggtgggcggcatcaacgaggcgatgcaaaggctgaaccagctgtcgcagggcaacgccgcggccagcgaggaattgtcggcggcggcgcaggaagtggcgatgcgcgcggacagcctgcgccggcagatgcagtatttccagcagggcgacgacgacaagccggcctagcctcggcgcgcgcccgcctatggaaaacccggccgcctggccgggtttcgttttgcgcgcgccgcggttttcaacgcacttcgcggatgtcttcgcgcgagatgcgcagccgcacctcggtgccgctggccagcaggtcgccggcgttgcggttgagacggtccacctgcagcgtggcgccgcgggactccacctggtagcggatgatgttgcccaatagctggtgttggcggatcaccgccggcagcgtgtcggcgccggcctcgccggcatcggccagctggatggattccggacgtatcgccagatggccctggatgtccaggcccagcagcgcctggctttgctgcgcggacagcaggttgtagttgcccatgaagcgggcgacgaactcggtggccggctgggtgtagatggtttccgccgcgccttcttgctccaccttgccctggttcatcacgaagatgcggtccgacatcgtcagcgcttcttcctggtcatgggtgacgaagacggtggtcaggcccaggcggcgctggatgtcgcggatctgctcgcgcaggtttttgcggatgcgggcatccagcgccgacaagggctcgtccagcagcagcacgcgcggctccaccaccagcgcgcgagccagggccacgcgctggcgctggccgccggacagttggtgcggaaagtgtttctcgcggccgttcagctccaccagcgcgatcacctcgccgactttgcggcggatctcgtcggcgccgcgcttctgcatcttcaggccgaaggcgatgttgtcggccacgttcatattgggaaacagcgcgtagctctggaacaccatgccgatgccgcgcttctgcggcgactggtgggtgatgtcgtcgccggccaggcggatggcgccgccgctgggtgtttcgaagccggcgatcatgcgcagcaccgtggtcttgccgcagccggacggcccgaggaaggtgacgaactcgccggcctccaccttcatgttgaagtcgtggaccacggcctgctggccgaagcgcttgttcagatggtcgatttgcagaaatgccatgatgctttccgtttccaattcagtgttcatcggcgccgagggcggcgcggttgcggctgaccacctgcatcaggcccatcgccgcccaggtgaccaggaaggcgatgatggccagcgcggccggctcgtaggcgcggttggcgccgatcaattgcagataggggccgaaggccgggcgcgccagcaggctggccagcgtgaactcgccgatgacgatggcgaaggtcaggaaggcgccggacaggatggcggttttcaggttggggaagatcaccagcctgaggatgtcgaaccagccactgccgaggctctgcgccgcctcggtcagcgagcgcacgtctatcgccgacaagccggtgtcgaccgagcggtacagatagggcagggccagcgtcacgtagccgaacaccaacagcaggtcggtgccgcgctcgttgccggtcagcggcagccagccgccgctgccgtacaggcgcaggtagccgaataccagcacgatggccgggatcaccagcggcagcagggtgagaaactcgatcagcggccgcagccgcggcagcttcagctgcacccagaaggcggtgggcaccaccagcaggatgccggccaggatggtcagcaacgccagcagcgcggaatagccgaagctggcctggaagccggggtcgctcagcaccaccttgtaggcttcgaagctatagccttcgcgtttcatcttcaggctgaattcgaaggtggcgatcaagggcagcaggaagtagccgctgccgagcaaaatggcgatccaggcgcccaggcgcgaagtggcggcggttttcatgcggcctcccggtggctgcgcttgcgcagccagatgtagccggcgttggcgctgccggtgatcagaaccatgcccaacgccagcgcgtagcccaggttctggtcgtgcagcacgtcgccgtggatttgcgcgtacagcagaatggtcacgatattcaatgagctgccggtcagcgcgtaggcggtggccaccgcgccgaaggcgttggcgaacagcagcagcgcggcgccggccaggctgggccacagcaccggcagcgcgatgtggcgccagtaggcgaagccggagccgcccaggctttcgcaggcttcgcgccattcatccttcaggccctccaccgccggagcgatgatcagcaccatcaagggcacctggaaatacaggtaagtgagggtgaggccggcgaagctgagaatggaaaagccgctgccgtacaggtcgaagtccaggtatttgcgcaacagcatggtcatcagccccatccggcccagcgtggacaggaaggcgaaggcgagcggaatgccggcgaagttggacgccacgcctgagaaggtggtcagcgtcgggcggatccaggcgggcaggccgccgcgtatcgccgccagcgccagcgcgaggccgagcagggtgcccagtatggccgaggccgcgctgatttccaggctgatctggtaggcgctgaggatattcggttcgaacaggcggatgatattgcccagcgtgaagtcgccctgcgcgtcctggaaagcgcccaccatcagcaaggcggtgggcaggatcaggaacagcagcgcgaacagcaggaagggggcgacgcccagccaggacaggatggatccgcgttgcggtttgccgctggagagtctgctgccgggaggggacatggtgtcggatgatgcggacatcgatatggtttctcttgccaggtaaaaaggccgccttcggcggcccggtgcgatatggctacgccaggtttacttgacgctgctgcccaccacgctgtcccactgcttggtgatgccggccttgtagctttcctgctgctcgatggtcgggaacacggccttcttgtaggcggcggcgtccggcagcttgccgatcagatcggccggaatcttcttccgggcggtcaggtcgttgaagcggatcgggtggcagtagcccttcagccaggccacctggccttcgtcggagtaaaggtattccatccacagcttggcggcgttcgggtgcggcgcgtaggcgttgatgccctgcgcgtacacgccggccaccacgccgctcttcggcaccaccacttccaccttggggttgcccttcagggtgtcgcggtcggccagcgcgttgtagtcccagcgcacgatgatgggagtggtgccctgggccagcgaggcggccttgccgatcaccggcacgaagttgccgttcttgttcagctgcgagaagaatttcaggccggcgtcggcggatttgttcacgtcgccgcgggcttgcgacaggccggcggcgaacacgccctggatggcctggttggcggcgcgcgggtcgccggccagcgccacggcgttcttgtattccggcttcaacaggtcggcccagtcggccggcgccttgctgatcaggtccttgttgacctggaaggtcagcacgccgtagtagtcgccgtaccagtagccgtccttgtccttggcgttgtccggaatggatttccaggtggacaccttgtacggctgcagcaggccctgggccttggcttgcgggccgaaggagaggccgacgtcgatcacgtcgggcgtttgcggacccttgttgttcttgttggccttgatggcctccagctcgtcggcggagccggcgtccggattcagttcgttcaccttgatgccgtacttggccttgaagccggcgatgacgttgccgtagccgcaccagtcatgcggcaggccgatcacggtcagctcgccttcctttttagcggcttgcgccagtgcggccagattgtccgccagagcggagttggcgatcatgctcagcgcgccgactacggcggcgtaacccagtttgttcttcatcattgctccccttcttggccattggcttatcaaaacttatgcgatggtatgagggattgatgacaaatccacgtcagtaatatgacaaaatgatttcagtgctggatgagtgcccgcgccggacggaaaaaaccgccgcggcgcgggcggcggggtcaggcgtgcagggcttccagacgccagtctcgcggctgttcggcgaagcggctggccaggaagggcgtgatgtccagcggcagggcctcgcggtgcgccagcttgtccagcagcacgccggtgatggccgaggtgaggatgccggtgcggaagtggccgcaggcgttcaggtatccgtccacgccgtcgaccggccccaggatgggcaattcgtccggggtgcccgggcgcaagccggcccagcaacgcttgatgttgatgcgcgcaagctccggcaggcagcgcacggcgccctgcaccagtccttggatttcggggtaggtggtgctgacgtcgtagcccttgtcctcggtggtgctgccgatcaggatttcgccgttgtccttttgcgcgatgtagcaatcgctggtggtgatgcagccgcgcaagagcttgggcattttctccgacagcacgatctggcctttcaccggcttcaccgggatggagaggccggtcgcccattggcatagctcatcggcccaggagccgccggcgttgatcagcgtgccgcaggaaaagtcgccggcttcggcggtgctaacgccggtgacgcggctgccctggcgcgccacgccggtgacgttgacgttgaagaacacgtcgacgccgttttgccgcgccgcctcggtataggcgtcggccaggcggaaggggctgacctggtggtcgcagaggaattccagcgcgccctgggcgctatggctgacatagggctcgtcggcgcgcaattgcgcctggtccagccagcgcacctggctggccaggtggggaatctgcgcggcgatgtgttcggcgtacagccggtcttcttcgtcgtagatgacgaatttcagcccggtttcctcaaacttgaaatccacgccgtgcttgtcccgcagctcctggtgcaaggccgggtacagcgcgttggacgccagcgcgaagtcgaaaaagcttttgggcaggatgtgcggcgcgccggcgctgacgttcaccgcggcgccggccgcttcgcgcttgcgcttggccgaggtcatgcggaagaagatcacgccgcagcccagtcccaccgattcgcctatcgcccacaggccgccggcggaggcgcgcgaggcgttgcccggccgcttggcgtctatcagggcgattttcagattgccgcgcttggacagctggtaggcgcaggaggcgccgatgacgccgccgccggcgatcacgatgtcgtactgcttgctcatgtcaaacctcttccgtcggttggggggcggtggtcggaaatgccgagaacggcagcgggtccagcgggaagcgcggccggatccagccgacgtcctgcttgccggtgtgttcgcgcaggcggtcgctgcaatagccgacgcacatcttgccctggcagtcgcccatgctgatccgggtgcgcatcttcaggctgatcaggtcgttgacgccctgttccagcgcggcgtcgatgtcctggcgggtggcgtgctcgcagcggcagatcaccgtgtccggccgcggcagcgccagctggccggcgccgcggcgggtgaagcggtcgatgccgacgcggaagcgcaggatggccgccagttggtccaggcaggcctggcgctgccgcagcgcttgctgctcgctgagaatgtggcgctgccagagcatggagatggcggcgatgcggccggtcagcatcgcggcctcgccgccgcgcaggccgccgatgtcgccggccaggtggatatgcggcaggctgctgcgctgccagtcgtcgctgtccggtttgaggaagccatcgtcgtggtactggtgcgccagccccagctgctgggtcagctgggtgcgcgggatgaagccgtagcccaccgccagggtctgcgccggcaggcggcgctgccgggacaggtcggcggtccagtcggcgtcgtagggcgcgacggtgatgtcgcgcagctcgtcctggccatggccttcgacgatgccccagccgtaatgcaggggaatgccgtggcgtttcagataggcgaccatgctcagcccgtccaggaacagttgcggctggttgagcagggcgatggcctccttggccagccggccgaaggcgcaggcttcgtagatgcccgccacgtcggcgccagcgcggtgcagctggcaagccaccagaggcagcagcggaccggtgccggccagcacggtgcggcccagcggcttgaccacgccgctcttgagctgcagttgcaggccgcccagcatgatgacgccgggcagggtccagccgggaaagggcacgctgcgttcgtggcagccggcggcaagcagcagctgcgagtaggctatcggctgcacctgctcatccggggacagggcgaacagctggccgccgtcgccgccgacgacgcgagtctccaggcggatgtcgatttgcgggcggaatggttcgaattcgcgatgcagcgcctgcatgttttcgcggtagcgctcccccaggtagtccagcaccacgccctggcgcagcgggccgcggtagaccacgccgcccagccgcgaggcctcgtccagcaggatgctgtgcacgccatggcgggccagttccatcgcggcggcaatgccggcgggaccgccgccgacgattagcggtttgccgttcatttcaagccctccgtatccaggcggttgccggcggtctccacccgcatgccggcttgcaccaccgtctggcaggcgcgccgtttgtggcggccgtctatgcgcacctggcagcagtggcaaacgcccatgccgcaataggagccggcgatctgttgctggtcgttgcggctgagccggcgcaggccgacggcgttcagcacgctcagcacggtttcgccggccgcggcggccacggcctggttgtcgatatggatggtcagagtctggccttgcagggcctggatgtcatggtcgcggtgtaaggacatgaagcaccttgctgtggtgaatggtgtggcaggttgagtttcgtggacaggaaggcccgccaatctccttccgtgtcccgttgccgcagcagtgaacgaatggcgccatttcggcttcaattgccgcaaatgatatgggcattgattttttgtgattgcaatgtttttagcatcgccttgcctgggtttgtttaatcaaaatcaacttttggacttaatctccaggaaagcgacaggcagacaaactgtctgtcacttttttgcaggaccatggttttcgaacggattttcactgtttgttaatgaaaatttgcaaaatcgttttaattaaaatttttaattaaaataaatatgttttatgcggcgagcggctacaaacgcttacatgcggaaacctaaatcctgctgaaggcgaagcgcgacgatgcaatgctgtagtcagtcccggatggatgccgggagcagattgcgccgcgcggcccgccgccggatcaggaatcgttgaggagacaagaaatgaaattgaagaacattggcattcagtggctggcgccgctgatcgccgccgccagcctgagcgcttgcgtggtgacgccgccgcgcgcccagatggtgtatcagccggcgacggtgcggctggaaatgccgcgcgactggcgcccggccgagcatccgtactatctgcacgcgatgagcgatctgcgcgcggcgcgcgcctatctggcgcacggcgactatccgcagatcatggatgacgagcgccgcgcggtgtccgagatcgacgccgcgctgggcgagatgcagcgcgccgccatcgaagacggcaaacaaccctggcgctacgagcagcccgatgcgcggctgagcccgaccgaccgcttccacaaggcgctggagctgctcgaatcggcccgccgcgatgccagccaccaggaagacgacccgtgggtgcgcgacctgcagcatcgcatcctccaccatgtagacgcggcgcaccatgcggtgcagcaagccatcaacgatgccctgcgctaagcgcgggccgatacccgacttcccaaggagagcgagatgaaattttccggaatactgatgatgttgacgatggcggccgccggcaacgcggtgctgagcagccaagccatggccgacggctggcgcgacggcgacgcctggacctggcagcagcaccagtggcatcccgaggagcatccctattatctgcacgcgatgaccgatctgcgcgccgcgcgcgatctgctggcccggccggattatccgcgggtgatggatgacgagcgccgcgcggtggacgagatcaaccgcgcgctgcacaagatgcgcgacgccgccatcgacgacggcaagaacgtcgacgaccgcatgccgccggatgcgcgctggcggccggaagaccgtttccatcaggccaagctgttgctggacaaggcccgccaggacgccacccaccgcgaggatgatccttacctgcgctcgctgcagcgcgacatcgtccatcatatagacgaggcgcgccgcgccatcgactacgcggtgtccgacgccctgcgctgagtcccgcgcgcccgccgcgtgtgacgacgcggcgggcttgcgctaccatctggctgataattaaagcctgatggagtattcaatgagccgaatcctggtgctctacaccggtggtaccataggcatggaccacaccccggatggcctggcgcccgtgccgggcttgctgccgcgcctgctgcagcgtttcgtccgcccaggcctggaattcgatgtcgtcgaattcgaacagctgatcgactcctccgttctcgtcccttcgcagtggaaccagatcatagacgcgctggcgccgcgctacgacgcctatgatggcttcgtggtgatccacggcaccgataccatggcctataccgccagcgtgctggcgttcgcgctgcagggctggaaaaagccggtggtgctgaccggcgcgcaattgccgctggtgcacccgcgctccgatggctgggccaatttggccgacgcgctggaagccgcctgccagcccgacctgcacgaagtggcggtggctttcgaccgcttgctgctgcgcggctgccgggcgcgcaagctggatgtggagtgctttgccggcttcaacagccccaacgacctgccgctggccgaattcgccatccatgcgcattggcacaagccgcgctggctgccgggcgaaggcgagcggcgggcgcagcgggtggacgaaaatctgaaactggcggcgctgatgctgaccccgggccatggcagcgcgctggccggccaggtgctgcagcgcgaagggctggatggcgccattctgctctgttacggcagcggcaatgcgccggcggacccggccttgctggccggcgtggcggcgatgacggcgcgcggctgtccggtgctgacattgacccaggtggcgcgcggcggcgtggaggtgggggcttatgccgccagccagccgctggcgcgggcgggcgccttgccgggggccgatctgacgcccgaggcggcgctggccaagctgcaggtgttgctgtcggccgggctggcgtggccggagctggcggccggtctggtgaggccgctgcgcggagagctgagcgcctgacgcgcgcgaaatgatcgaaaatggctgcctaaataatgggcagccattttttgtttactcgattcaatggcttgcccagcttgtccacagcgagtccacacggctttgcaccgcaggtgtgggaaagggcgatgtctgatccgccgccgcagggagggatggctcgatggggttgcttaaaaaataggctagaggccgagccgggtgtcaaatcaggggtttgcgtcggttgtccacatgtcgcgaacaggattgccgggcgcggatggggattatcgcggcgcgcggcgcgggatgggttgcctaaaaaacaggcagctccgcttttggcttgtttctcatgggtttgccgcgtttatccacaatgcgcccacatggctctgcaccgggattgggggaaaagttcccgtttgaccaaaaaataggcggaagaagaaatgtcgcttggtttcaatggtttgcctggcttgcccacagccagcccacagccctgtccccggcggctgtgaaaatccgggaaagccggcggcggcgggttataatggccggcttggtcccggcgactgcggcgcctgccgccggccgtggacgggaagcgtgaatgatgcggcacaagcaagcccaagcgcctgtcagggtggcgatagtcggcccggagtccagcggcaagagcacgctggcgcgggaatgggccgaacagctgcgccgcgagggccggcgcgcggcgtgggtggcggaatactcgcgtgcctattatgccgatcggccttatatttccagcatggcggacatcgaggcgatcgccgccggccaactcgcggccgaggagcaagcggccgcggccgccgacatcttgttgtgcgacaccacggtgctcacctgcaagatctgggcggaggtggcgttcggccaggcgtcggccgagttgctgcggctgtatcggccgcaggattacgcgctgactttgctgacccgccccgacatgccctggcagcccgaccccttgcgcagccatccgacgcagcgcgattggctgctggagctgcaccgcgccgaactggcccgcgccggcatcgccgccgtcgagctggcgggcggccgggaagcgcggctggagcaagcggcacgggcactttggccgcttttgcctgcctaaaaaacaggcaggtgtaaaaggcctagcgaaatcagcggattgccgcgcttgtccacagcggctccacaacattgttcgccggcgaagtggatagcctggcgcggctgcctaaaaaataggcggccttgaaaagatcagacagattaagggcttggcggccttgtccacaggccgctcacaagcctgtccagaatggatgtgcagaaaatgaaagaaacgttccgtctcaatagcgaatacatcgccttgtgcgacctgctcaaggcctgcaatgtctgccagtccggcggcgaagccaagcatttcatcgccgaaggcaatgtgcaggtcgatggcgcgcaggagctgcgcaagacctgcaagatccgggcgggccagaaggtcagcggcgacggtttcctgatcacggtcgaggccgcctgacatggacgacgcgacggacgccatgccgcagcctccgttcgaggtggatgacgacatgtgctgcggcagcggctgcgagccgtgcatcctggatatccatcagcaggagctgcgcgcctaccgcgcgaggctggcggcttgggaggcgcgccaggccgaagggctggccgcgggagacgccgatggccggcattgatctgcatttccactcgcgcgtttccgacggcgcgctgacgccgaccgaagtggttgaccgcgccgcgctgcgcgcgccgtcgctgttggcgctgaccgaccacgactgcaccggcggcctggccgaggcggccgcggccgcggcgcgcaacggcatcgatttcctcaacggcgtcgaggtttcggtcagctggggccggcataccgtgcacatcgtcggcctgggcatagaccccggccacgcgccgctggccgccggcctgcagcgcatccgcgatggccgggtggagcgggcgcggcagatgggcgaatcgctggccgcggccggcatcgccggcgccttcgacggcgcgatgcgctggtgcgacaacccggaaatgataggccgcacccatttcgcccgccacctggtggcgtccggcgcggtgaaggacgtgcgcacggtgttccgcaaattcctgacgccgggcaagcccggttatgtcgcccatgactgggccagtctggaggacgcggtcggctggatcgccggcgccggcggcatggcggtgatcgcccacccggggcgctacgacatgggcaagacgctgatcgagcggctgatcctggacttcaaggcggcgggcggcgaggggatagaagtcgcctgcggcagccacagcctcgacgacatgcacaaattcgcgctgcacgccgaacggcaccagctgtacgccagcagcggcagcgatttccacgccccgggagagggcgggcgcgacgtcggctacaccgagccgctgccgccgctgtgccgccccgcctggctggcgctgagcgggcgcgtgatccgcgccgcggcctgacaaggacgaaaacatggcccagtttttcatgatccaccccgacaacccgcaggcgcggctgatccgcgaggcggtgaagatcctgcgcgacggcggggtgatcgcctatccgaccgactcctgttacgcactgggctgcgcgctgggcgacaaggcggcgatggagcgcatcctggacatccgcggcctggacctgaagcagcggatgatgaccctggtctgccacgacttgtccgagctggccaactacgcccgggtggacaacagccagttccgcctgctcaagagcgccacgccgggcagctacaccttcatcctgcaggccagccgcgaggtgccgcgccgcaccctgcacccgaagcgcgccaccataggcctgagggtgccggaccacaaagtggcgctggccttgctggaagagctgggcgaacccatattgtcctgtaccctgatgctgccgggcgacgccgagccgctgtccgacccttatgaaatccgcgaacgcctggagcacctggtggacgcggtgatagacggcggctggtgcggcaccgagcccaccaccgtcatcgacatgaccgacggcgtcgagctggtgcgctcgggcaagggcccgctctcgcccttcggtttttgattcatttttgctctagagaaaacatgcagtcactttccttgattcagcaactggcgatctccatcctgccgattcttttcgccatcaccgtgccggccggcgcgcaggcctatatggccgaccatctgggcgaccgcaccgcctacatgaccggccgccgcaccttcagcccgctggcccacatcgacccggtgggctccatcctgctgccgctgctgggcgtggcgctgggcggcttcatcatcggctggcccaagtcgctgcaactgaacgccggcgccatgcgcaagccgcgcagcgcgctggccaaggtggcggtggtgacgccgctggccaatctggcgatggcgctgctgtgggcgggcttgatcctggcatccgcccatgtgccggcctatttcgccgagccgctggcgctgatggcgctggtgggcgtcaagatcaatgtggcgctgatgatcttcactctgatcccgctgccgccgctgccgggcggggtgattttgcaggcgctgctgccgcagcgcgcggcctggcagttttcccgcatcgagccctatagcttctggattttgctgctgctgatgttcagcggcctgctcggcaagctgttgctgccgctggtgcaagtgattttccagctgatcgtgggcgtggcggcgggctgagccccgcgctgtcgcggccggctatctgccgccatggcgacgcctggcggaaacgggagacgaagccatgttggaaatagaccagctggtccggcagatcaccatctacgcgctgccgctgttgttcgcgattaccctgcacgaagcggcgcatgcttatgccgcgcgccgcttcggcgacagcaccgcctacatgctggggcggatgacgttgaatccgctcaagcacatcgacccgatcggcacggtgctgctgcccttgctgctgttgatgaccggcggcttcatttttggttgggccaaaccggtcccggtgaacttcagcgctttgcgcaagccgcgccagcacgggcgctgggtggcggcggcgggcccgctggccaatttcgcgatggtcatcctgtgggcgagcctgcaaaagctggcgtctgttggcgtgggcgaattcagcgagccgctgtggctgatgggccgcgccggcgtcgccatcaatatctcgctgatgctgctcaatctgctgcccatcctgccgctggacggcggccgcatcgtcgaaagcctgctgccgccgcgctgggcctggcgcttcgcccagaccgagcgctacggcatgtggctggtgttgatcctgctggccaccggcggcctgggtttgatcctgcagccgttttaccgcttgatgtatgatctgatccgactgtttttctagaaccttaggcggggcccgccctgccgccggcagcagccggcggtgtttcgccccgcgccaatgaaagcaaaacaatatgttcgccaaccgcattctttccggcatgcgccccaccggcagcctgcacctgggccactatcatggcgtgatcaagaactgggtggaactgcagcacagtcacgaatgctttttcatggtggccgactggcacgcgctgaccaccaacttcgacgatgtctcgatcatcggcaggtccatcgatgaaatggtgatcgactggctggcgtccggcgtcgacccggaaaagtcgacggtgttcgtgcagtcgcgggtgccgcagcacgccgagctgcacctggcgctgtcgatggtgacgccgctgggctggctggagcgggtgccgacctacaaggaccagatggagaagctcagccacaaggacctgaccacctacggcttcctcggctatccgctgctgcaggcggcggacatcctggtgtacaaggccggcctggtgccggtgggcgaagaccaggtgccgcacatcgagctgacgcgcgaagtggcgcgccgcttcaaccacatgttcggccgcgagcccaatttcgaggagctggcgcgcgccgcggtgaaaaagataggcaaggccggcaagcaattcgatcagctgcgcaccgcttacctgcaggacggcagcgccgaggcgctggagcaggcgcgcgaaatcctggctggcagccagaacctgggcgcggccgaccgcgagcggctgatgggctggctggagaacaagggcaagaccatcctgcccgagtgcgaggccaagctgaccgccgcctccaagatgccgggcctggacggccagaagatgtccaagtcctacggcaacaccatcaccatgcgcgaagcgccggaaacggtgagcaagaagatccgcggcatgccgaccgacccggcccgcgtgcgccgcaccgacccgggctcgccggccaagtgcccggtgtggcagctgcacgaggtgtacagcgacggcgcaaccaaggaatgggtgaaggcgggctgtaccagcgccggcatcggctgcctggactgcaagcaaccggtgatcgacgccgtggtgcgcgagcagcagccgatgttcgagcgcgccgagaaatacctggccaaccctaagctggtcgccgaaatcctggccgacggcaacgcccgcgccgagaaggtggcgcgcgaaaccatgtgcgacgtgcgccaggcgctgggcctgggacgctgatccggcgttctgtcccgcagacatcccggccgcttggccgggatttttttcgcctatttctgctgcagcagctccgatacctcgcgcaccacctgcaccacgtcgcgggcgccgtcgcggatttccgaaatcgcgccgcgggcctggtcggccagttgcaagctgctgtcggtcagcgcctgcatttcgcccatcgcgtcgatggccgagcgcgagtcgtcctggatgctcttgacgatgccggagatttcgccggtcgactggctggtgcgttcggccagcttgcgcacctcgtcggccaccaccgcgaagccgcggccgctctcgccggcgcgggcggcttcgatcgccgcgttcagcgccaacagattggtctggtcggcgatgtcgctgatggtgttgacgatggagccgatccggctggagctgtcgcccagcttggacaggatggtggacgagctctccacgctgtccgccacccggctgatctcggtggtggcctgctccagcaccgcgctgccttgcaccgacagttgggcggtgttttccgacgcctgcaccgcggactgggcgttttccgcctgctgttgcagccgctccacctgctcggtgatgtcggtggcgaatttcaccacccgcagcggccgtccgtccgggtccagcaccgggttgtaggtggcttgcagccagaccggacggccttgcttgtcgacgcggtgatactgcccctgcatgaagcggccctgccgcagctgcgcccagaaatcctggtaggcctggctgtgggcgtagccgctttcgcacagcatgctgtgcggcttgcctttcacttcggccagcgcgtagccgaaggtctgcaggaaattgtcgttggcgtcgaggatatggccttgcaggtcgaactcgatccgcgccatcgaatggtctatcgcctggcgcagggccttgttgtcctgctccgccgccacctgggcggtgatgtcggtagccaccttgatcacgccgctcaccttgccgtcggcgtccaggatcggcgtgtagttggcttccagccagacttcgccgccgtccttgcgcaggcgcagaaaatgtccggattggcattcgccgcgcgccagtttttgccagaaggcggcgtaggccgggctgttggcgtagccggccggacagaagatgcggtggtgctggccgatcagttcatcgccgcggtagcccatggcgcgcaggaaattgtcgttggcgtggacgatttcgccggcggggctgaattcgatcaccgccatcgagcgttcgatggcggccagcatgtcgcgggccttgtcccgctgggcggtggtctgctccagccggctgatgagtttgcggttgaaaaaagccatggtgattccttgtcgggtgcgcgcgggtgttgttgttatccgctgataggtacgcgggaaatgccgcagtgtacttaagcataagtaaatttactgatgattcgaatgatatcgcgtcgagacgacaaacggcgaccatgaagacatggccgccgttcgcgcgcgaggggaggaggatcagtccagcttgtattgcacgcctagggtcagggtgcggccggtggggtcgtactggctggaatcgtagtagatgccggcgtgcgaatcccagggcggccggcgattgctcaggttttgcagcgcggcggtcagcgtggcgcgcttgatgcctttgtagctggcgctgaggttgaaggtattggcgctgcccacccgggtctggtcgccagcgccgctgctgaaggcctgggtgtagccgtcggtgtggaaccaggtcagcgtgctcgaccagtcgtggctgtcccagctggccgaggtttggcccttccagcgcggcagcgcgcccagcagattgctgccggcgccttcccgcagcgcgccgccttgctgcaacggctggcggaacgacagcaggcggctccattgcgcggccagcgtcacccggccgccgcccagtttccagctttgccgcaggtccaggtcgaagccggtggtttcgcggttgcccagattggtgaactgctgggtgatggtttgcaaccggccctggctgtcgcggacgatctggccggggtaggcgccggggttgcgcaccagattgtcgatgtcctccaggccgatcacgtccttctggcggatgcggtagtaatcgatggcgatgctgctgtccgcagtgggcgacagcaccaggcccaggttggcgttggtggagtgctcgggcttgatggccgggttggccaccaccaggtgggtgaagcctatgctctggttgggcgtgatggggtcgtacgggtcttgcacgctgccgtagctgaccgcggtgctatgggtgatttccggcagcgatggcgcgcgaaagcccttggacaaggtgccgcgcagggtcaggctttgcagcggctggtagcgcaggcccagcttgggcgagaaggcgctgccgaagtcgctgtagtggtcggcgcgggcggcggcgctcagcgacaggttcttcacgatgggcgcgttcaattcgccataggcggcctgcacggtgcgggcgccgttgatcaggtccagcgccggccgcaattcggcgccgctggccacctcgggcgaggtgccggcattcatcatttcgcgccgcagctgatagccggcggcgaagcccagcgggccagccggcaattggccgagctcggtgctggcggtggcgtcgaagctggcggtgcggtaccaggccgggcgcagggtgctgatgcgcaggctgtttctcgcttgatcgttgttctgcgacgggtcggcgaagttgtagccgccgttggccagcaaggcttcgtaggcatagcggttgacgaagttgtacgcgtactcgcgcagccggctgtcggaatacaggccggacacgtcccagtcccaggcgtcgccgctgcccttcacgcccgccagcaggcggcggaacgacacgctgtcggttttgttgcgctggcccaggtcgaacaaggtggcgttgatcggcgtcggcgtcgcgttgggattgccggggttgccgacgggcagcacattgctgatcggcaccagcgactgggtggcgctgttccaggcgcgcagcgagctgctgatggtgagcggcgggccgaaaatctggttgctgtggctggcgccgtacaggaattcggcataggcctcggcgccggcgttcaggcggtagctgccgcgcagcgccgcgtggtagcgctcgatgccgggcatcagcgtggtgtagagcgccggattgtaggcccagacccggccgctcttgcctgggttgaccgcgccgtagtcgatgtcctgcagcggccccgcggcgttggggaagcgctgggcgggggcgccgttgtagtagttggtgacgttgcgcaccagcgagccgccttgctggttgcgaaaatcgttatctttcagccaggaaacgtcggtctggtccagccggtcgcgcttttgcgcgtcgaaggagaaccagacgttgtagccgtcgcgctcgaggtcgcccttgccggccagcaggttgaactggcgctcgttctggccggtgctggcgtcgcggctggcgctggcgcccagctccgcgccctggtagtcggggtagaggatgatgttgaccacgccggcgatggcgtcggaaccgtaaatggccgacgcgccgtccttgaggatttcaatccgcttcaccgccttcagcggcagcgagttcaggtcgacgaaagtttcctgcagctcctgagcggtggcgtagttggcgacgcgcttgccgttgaccagaatcagcgtgttgcgctggcccaggccgcgcagcgaaatgccggcggtgccggcggagaagctgccggtgtattgctcgttgaagctgttgccgctgttcaccgccagcgagcgcagcacgtcgggcaggctggtcttgccgctggaagcgatgtcggcggcgctgatcacctgcaccgggttggcctttgccttggagctggcgcgcaggttggagccggtgacggtgacgcgttccagcgcgttgtcctggggggcggaatcggcggcgagggcggcgatgggcaaagcggcgcccagcccggccagcagcagggtgtgtttcatcatggaaaggctttcttgtttatgcgggtaaggcggggctgctcggacggcgcgcaggcgtcagccgggcaggcgcggacagcggatggctggaaggacgaggctggggagcatggctttcatttctggatacaaaatacataatggaatatgcagaatgtatcgacgctgacgatttgtgtgaaatgaaagattcggattagttaattcctggggcgggaaattgcccgccggcgcggcggccggcggggagggcgggcgtcaacgcggcggacgcagcgcttccatctgttggcgctgcgtctccacgcaggctttcagcgccggcggcgtctgcgccgcctggatgcagctttggctggcttgcaggatctggatgcgctgggcgtgctcttgcagcagcttggccttcatttccccaaagcgggcttggccgcgcggggcggaggcgccgggcgcggcgcaggccagcgcgggaatcagcagcaggatggcgggcaggatgttcatatcggctccgaagcggtttaccccgcaggtatacaccatggcgcggcgggccgctcagtcctgcgcttccacctcgccgccggcgctgacgcgggcgctgatcaccttgccgctgccgacattgcgcacccggatcacttcgcccatgcggccgttggccagcgcctcgccggcgttgctgacctcgatgccgtcttggcgggcgacgatgcgcacctcgtcgccgcgcttcaccaattgcggcgcttgcagctgcttgcgccgcagcagctggccctggctcagcgccgcgcgcggcgccaggcccaagggcgtgctggcctggccgaacaggtcggccggctcgctgaccgggcgccggctccagctgatgtcttctttctgcagcggcgcgccggccggcaggtcgcgggcggcgctggccaccctggcgctgacgctggcgcgcgcgatgtagtcgccgcgccagtcgccatccgggcaagcgacgctgaagcgcatgcggctgaaggcgcggctgtcggtcgcctccacctgccaggggcgggcgcaggcgggcaggtcgcgcgggggaatcagctgcagcgtgatgccgggctggtccaggccggcgtcggccagccgttgctggatcagctgggtggcctgctggcggaccgcctgttcggcggaatggccggcctgggctggcggcgccgccagcagggcgaacagcgtgaggatggttgcgtagtgtgagttcgtgaattttgccattagaaactgcgtggtaattgttgcgtatacggtgccgggttcgcttattagtatcgctttccaatagaaaggctatttctagtcaatagcttgaacatggtagtgaactgatagggtcaaggcaatgggcatgcatctggacaaggccctgagcatccaccccgaagccttgcggctgcgggcggagcggacccgggtgctggcgtctaacctcgccaacgagaacaccccgggttatcaggcgcgtgacatcgatttcaaggcggcgctggcatcggccagcgccgattcgccgttggcgctcgacgacggcggcggcgatctgctgtatcggctgcccaaccatccctcgcgcgacggcaataccgtcgagctgggcgtcgagcaggccgagttctcgcaaaacgtttccgaattccagaccagcctcaccttcatcaatatgaagctgcatgggctggccaaagtcatcgcggggtaatcaagcatgtcattccgggacatctcgcgcatcgccggctcggcgatgaccgcgcagaccgtgcgtctcaataccgtggccagcaacctggccaacgccgacaccgccgccggcaccgagcaggcggcctatcgcggccgcaagccggtgttcagcagccagatgcagggcgaaggcatgggcgtgcaggtgctggacgtggtgcagaaccaggagccggtgcgcaaggcgcacgagccgggcaatccgttggccgacgccggcggcaacgtcttctacagcaatgtcaacgcggtggaagagatgaccgacatgctctcggccagccgggcgttccagaccaatgtcgaggtgctgtccaaggccaagagcatgcagcaggatctgctgaaactgggagacaacgcatgagcgtggatcaagcgcaggccaaaccgttcgccgcgggcggcaacggccagcaagcgggcgggcagggcgtcgccccggccgccggccagggttccggcggcaacgatatgttcatgacgctgctgctggcgcagatccgcaaccagagcccgctggaccctgccgacccgtcgcagttcgtcagccagctggcgcagatgagccagatgcagtccacccagggcatgctgagccagttgcaaagccagggcgcgatgctgcgcgagctgcaaggcgtggcgctgggcgcacaggtgggcaagaacgtgctggtgcagaccgaccgcatccgcagcgacggccagggcaatctgtccggccgagtcacgctgtccggcgccgaggaaagcgccacgctgaccctggtggacgccgccggcaaacgcaccaatatcgcgctgggcaagcgcccggccggcgccagcgatttcagcgtcaagctgtccgattacggcctggccgcaggcgactaccaggtggagttcgccaccgaatcgaaaaaagccggcctgctggagctgcaggccgctgtcagcggcgtgcgcctgccggtgaacggcggcgagccgaccatcacgctggccggcctgggcgatttcccgtcctcttccatatccgccttgctgggcaagcccggcagttccgcttaacgcccgttccggagacttcacatgagttttgaaattgcgctgtccggcatcaacgccgtcaacaaccaactgggcagcatcagcgacaacatctccaactccggcacctacggcttcaagtccggccgggtgactttcgcttcggcctacgccggcagccaggcgatgggcgtgaacgccaaccccaacaaccagaacatcggccgcagcggcggcgtggtgaccaccggccgcgcgctggacgccgccatcgacggccgcggcttcttcgtctccaagagcgtggccggcgcgatggcctatagccgggtcggcatcttcaacaccgacaaggacggctacctggtggacaactacggcggccgcgtgcagggctacgccaagtccgataccggcgcgctgggcgcgatgggcgacattcagatcccgaccggcaacattccggccaagcccagcgattcgctgcagtacaccggcaatatgtcggccggctgggcggtgcagaccgtgccgttcgacaagaccgtcagccaaagtttcaaccattccaacgtatccaccgtctacgattcgctgggcaacaagcacaatctgacgcagtacttctgcaagagcgccgacagcaccgtcaccgtgcattacgcgctggacggcaatctgctgggcaccaccaccgacctcaagttcgacaccaacggcaagctgaccgcgccgaccgcggcggtcaacctggggctgggcagtcccgctggcgcttcggcgctgaacgtggcggtggactacaccggcaccacccagttcgccggcgagcccagcaccagccgcaacgccaccaacggctacgcgccgggcgcgcgcaccggcgtcagcctgggcgagaacggcgaagtgatcgtcagctacagcaacgaccagaaaatgacggtggcgcagctggcgatcgccaacttcgccaacgaaaacgcgctgaccgccggctcgcagaccagctggcaggaatcggccggctccggcgcggcgctgtattccgtcgccggcagcagcatggccggcaagctggccaccggttcgctggaacagtccaacgtcgacgtcaccgccgaactggtcagcctgatgaccgcccagcgcaactaccaggccaacaccaaggtgatttcggcggaaaaccaggcgatgcaagcgctgatgcaggcggtgtaaggcatggacgcgctgatctacaccgcgatgagcggcgccgaccgcatgttgaaggcgcagcagatccacgccaacaacctggccaacgccgaaaccggcggcttccgcgccgacattgacgccgccaccagccaggcggtgcctggctacggctacgacgcgcgcctgctgagccagaacgcgcccaccgtgctggacagccgcaacggcgcggtggtggaaaccggccgcgatctggacatcgccttgcagggcgatggtttcctggccatcgccgcccccgacggcagcgaagcctacacccgcgccggcagcatgacggtgggcgccgacggcgtcctcagcgtcaacaaccggccggtgctgggcgacggcggcgccatcacgctgccggagggcttcaccaaggtcagcgtcgccgccgacggcaccgtgtcggtgctgaatcccggcgacaccgaaatgcagccggtggacaagatcaagctggtaaagccggagccgaacgcggtgaccaagagcgccgacggcctgatcgtcagccgccagggcctgcccttgccggccgacgccagcgtcagcgtgcaaagcggccatctggagcgcagcaatgtgtccgcggtggaggaaatggtggccaccatgacgctcaaccgcaacttcgagatgcagatgaagctgttcaacgccgccagcgacatgaacgaggcgggcaaccgcctggtgcgcgcgtaagcggccagcgcaacgatttggagaattcagcatgaatccggcattgtggatcagcaaaaccggcatccaggcgcaggacgcgcgcctgaccgccatcgccaacaacctggccaacgtcaacaccaccggcttcaagcgcgaccgcatggtgttcgaagacttgttctaccaggtcgacaagcagccgggcagcaaggtggacgacaacaacatctcgccgtccggcgtgcagttgggcaacggcacccggctggtgggcagccagaaggtgttcaccgaaggcaacctcaccaccaccggccagtcgctggacgtggccatcgtcggccagggctttttgcaggtgaagatgagcaacggcgaaaccggctacacccgcgccggccagttgcagctgaacgccaacggccagctggtgaacgcgcagggcctgccgctggagccggaaatcaccattccgcccaccgccaccaaaatttcgatcagcgagaccggcgcggtgtcggtgaccgagggcggcagcggcacgccgaccaatgtcggccagatcaccctggccaacttcatcaaccccaccggcctgttggcgctgggcgacaacctgttccaggaaaccgccgccagcggcaaccccaccaccggcaatccgggcgccgacgcgctgggcaagctcaagcagggcagcctggagggttccaacgtccaggtggtggaagaaatggtggacatgatcgccgcgcagcgcacttatgaaatgaacaccaaggtgctgtccgccgccgacaacatgctgcagcaactgggccaggcggtgcgatgaggctgatccgccttgcgccgctggcggccttgctgctggcggcttgcgcccagttccagcctgcgccgccggaggcggatccattgcccgatctgttgcagcagcaggcgcagaccagccgcggcggcggcgtgttcaccccggcgggcgcgctgtcgctgacgtcggacaatcacgccttccgcgccggcgacgtgctgaccgtggtgctggaggaaaccacccaggccagcaagcaggccggcaccagcttcggcaagaagtccggcgccaaggtgggcccgacgctgctgggcaataccaccttcaacgcccaggtgggcatagacgccagccgcgatttcaacggctcgtccacctccacccagcagaacgcgctggccggctcgctgaccgtggtggtgcacaaggtgctggccaacggcctattgcaggtgaagggcgagaagcagctggcgctgaaccagggcgaggaaacgctgcgcctgtccggctatgtgcgagtggaggacatcgacaccgacaaccgcgtctcctcgctgcgcatcgccaacgcccgcatcggttattccggcaccggcgcgctggccgacgccaacaatgccggctggctgatgaagttcttcgccagcccgctgatgccgttttaaggtttgccatgaaactagggtttttccgccgcctgctggcggttgtggtgctggcggcgtgcgcgccgctggtttgcggccagccgctgcggcagatggtcaacgtcgagggcatccgcgacaaccagctgataggctacggcatcgtcgtcggcctggacggcaccggcgacaactcgcaggtgaagttctccggccagtcggtcgccaacatgctcaagcagttcggcctgaaaatgccggagaagaccgacacccgcgtcaagaacgtggcggcggtgatggtcagcgccagcctgccgcccggctacagccgcggccagaccatagacgtgaccgtatcgtcgctgggcgacgccaagagcctgcgcggcggcacgctgctgctcacccagctgaaggcggccaacggcgaggtgtacgcgctggcccagggcagcgtggtgataggcggcttgtcggctcagggcaagagcggctccagcgtcaccgtcaacacccccactgccggccgcattcccaacggcgcgtcgatagagcgcgagattcccagcgacttcgagcaaggcgacagcatacggctgagcctgcgccgccccagctttgaaaccgccagcaatgtggtcaaggccatcaaccagagctacggcaagatcgccagcacccgcaacgccaccaccatagaagtgaaggcgcccgccgatcccacagagcgcgtggccttcgtcgcgcggctggaaaggctcaatgtcaatgtcggcgccgaactgccgcgggtggtgttcaattcgcgcaccggcaccgtggtgatcagcgagggcgtcaccgtgcggccggcggcggtatcgcacggcagcctgcgggtggtgatctccgaatcctcccaggtcagccagccggggccgttcagcaacggcgacaccaaggtggtgcccaattccaacgtcaacgtcgagcaaggctcggggcgtatgttcaagtggcccgccggcgccagcctgcgcgccatcatcgatgcggtcaaccgcaccggcgccacgccggacgacatcatggccatcctgcaggcgctggaccaggccggcgccatcgacggcgaactgattgtgatttgaggaaaacggcgatgctgaacaacgatctgcaaaaccagaacctgccggccggcggcgacgcgccggtggcgccggccagcgccgaataccgcaagaaagcggaaaaggccgccgaacagttcgaggcgcagttcgtgcgcgaaatgttcaagcagatgcgcaagaccacccgcgaggtggcgggcgaggacagcgtgttcgccaactccatcaacggcgacatgatggacctggccgacggcgcgctggccgaccagctggcgcaccagcgcattttcggcgtggccaacgccattctggcgcagctgctgccggcggatgggaatattgccattaagccgccggcggatgccgtcgccagtcaacagcaaggccatgacaatggccaggggctggcggctttcgccacgccgatgtttcccctgaacaagtgatgacagccaaaccatgcgcatgatcaacaacgcgctgtccggcgcgcaggccgcccaggtcgcgctgaatacggccagccagaacatcgccaaccagcagacgcccggctactcgcgccagggcgtggtgctgaccacccaggcgccgggcatgggcgaccccaccagcgcaggctacggcgtggcggtcggcagcgtgcgccgcttcagcgacgactaccgcaatctgctgcaatggcaggcggcctccagcctgggcgagcagtcgtccgcccagccttacttcactcagctggagaaggtgatgggcagcgacggcagcagcctgtccagcggtttcgacaaattcttcgccgcgctcaacgccgccagcctggattccaacaccatgcgcgaccaggtggtgcgcgaggccggctcgctggcgcagcgcttcaacaatctggacggcgtgctgacgtcgcagctggcggccatcgccgagcagcgccgcgccacgctcacccagatcaacagcgtcaccgccaacctggccacgctcaacgacaagctgatgtcggcgcgcgcgcaggggatcaacacttccgggctggaggacgagcgcgaccgccagatcgacgcgctgtcgtcgttggtggaggtgagggtggtggcgcagcctgacggcagcaagagcgtcaacctgaagaacggcctgccgctggtggccggcgacagcgccgcggtgctggacagcgaaggccagccggatggaacccagcagctgaagctggttttcggcaccgagaagtatgcgattccgggcggcgatctgggcggccaactgggcgggctcaaccagtttgaaagcgacaatctgcggccgatccagacccaggtgcgcactttggccggcgagctggccaaccgcgtcaacagccagctggccaagggcttcgatctgaacggccagccgggcaagccgctgttccagtacgatgccggcgccgcccatggcctgctgcagaccaccggcatcgccgccgccgatttgggtttctccgccgacgcggccaaacccggcaataacgacaatctgcgcgcggtgctgaccatcaagcagcaaaccttccccttggccggcatcggccaggtgacgctgggcgacgcttattcgcagatgatcggccacctcgccatctccagccagcagaaccagtcggcgctcgacactgccaatgtgatccgcgccgaggccgagaagaactggcagtccaccagcggcgtcaaccgcgacgaagaagcggtcaacctgatcgaataccagaagatgtaccaggccaatatgaaagtgatttcggtagccaaccagctgttcgaaagcacgctggccatcctgtaaggacaagcatgcgtatctccagcaaccagtaccgctccaccctgcagctggccatgcagaacaccagttccggcatggccgacctgctgcagaaaatgtccagcggcaagagcatgctggccgcctcggaaaacccgatcgccagcgtgcggctgctgcgtctgcagcgggaggaggcttcgctcaagcagtatcgcgacaatatcggcgcgctcaagtcgcagttgtcgaagaacgaggccctgctcgacggcatcagcgccaatctgcgcgacgcgcgcgacatcctggtggcggcggccaaccagccgccggcagaggacctgaaggcgatggccgcgccgctgaccagcctgcgcgacagcattctgttcgccgccaacaccaaggacagcgaaggccgctacatgttttccggcagcgccatcaacaccgccaccatcgcggtggatcccagccagccggccggcagccgctacagcttcgccggcaacaccgacagccagctggtgacggtgggcgagggcgtgacccagtcttccaacgtcacgctgcagccgatggcgggtttgctcaaccagctggacaaggtgatcgccacattgcaaagcccgacgctggacaacaaggacccggcgttgggcgcttccatccgcggcgtgatggacggggtggacggcgcgctgagcgaagtcagcggccgcatctccgaactgggcggctcccagaacgtgctgcagacgctggacgacaatcacaatagcctcagcctggccaaccagcagagcattctggagcttggcagcctggattacggcaccgcctatatggacatgaacaatctgtcgatggccttgcaaaccagccagaaggcttacggcaaggtcagccagctgaccctgttcgacgtgatctgagtccgcagccatgtccagcacgctcagctcgatcaagcatgccggcgcggacaagcgctggggcaaggacggcgcggccatcgcgccggccgccagccgcgccgtcgccggcggcggccgccccgcgctggccagcgcccagccgtcggcctccgcggcggcgggctggcgctacagcacccagctcaacgaacagctcaccgccgcccagtgcgcgcagggcttcgtcgacgacatgctgcgccagctggaggatttcaagggcaatctcagcctgcagctcacccagcggcgggtggacgatgacggcctggccgcgcagcgcgatcaactgcagcaaagctggttgcagcggcaggacgatagcgccggcagcttggacggccaactgcggctcagcttgggcgcgccgtcgcgccagctgttctccgcgcgcggcctggacctggacagcctgagccagggccagccggaaaccctggtgttttccggcggcggcggcgcgccggccggcgcggtgagggtgggcgacggcgtcggccgcgaagaagtgctgcggcggctgaaccaggctttggggccggctagcgtgcgctgcgagctggacaaccatggccggctgggcttcagctgcagcgaggccgactggagccggctgcgcgacagcctggcggtgcgcggcggcggcgtgcgttttcccggcggggtgccgcagccgctggcgctggatgccgagccgccggctctggccccggcgcagtggcaggtgggcgaccacgcccaagtgcggcaaacgctgcagggcgtgctgcgcgccatcgcccagctgcagcagacgcgggccaccataggcaacgccatcgccgaggcgcgccagtccatcagccagctggcgcggcaggatgagcccagctgggcggacggcttcgtcagcgatttcaacgcccgcctcaatcagggaggggacttcggccagctgcaacagctgttgccggccttgatgggcatcagccgctaccgcgtgttgtcgctgttgtcgctgcgctgagcgccgacgccgggccgctccgctggggcggcttttttttgcccggcaggcatgccgtcttcatacttccttaatgtgatgatgtcataatcagcgattttgcgaaggaggccgccatgcgcagccgctgttggccgctggccctgattttgtcgtccacgctggcccgcgccgatttcaccattcccggattcgagctggtgcataccgcgccgcagcatgcggggctggacacaccggatttgcgcgacccggccgtagtatggagcgagttgttcgactccgcccgcacgcagatcgtgctggagcagttttacgcggcggatcaggcgggcagcaagctgacccaggtgatggatcggctggaagccgcgggacggcgtggggtgaagatacgctttctgatggaaaagaagggcatgttcgccagcgaggccgccaccatcgcccgcctgcagcgcattcccaatctggaataccgccagctcgactacagccagctcaccggcaacggcatcatccacgccaagttcatcgtggccgacggcaaaaccgcttacgtcggcagccagaatttcgactggcgctcgctccagcacatccatgaaaccggcctcaaggtggacgacgcggcgatggccggccgcatgcaggccatcttcgaacaggattgggccgcgcaagagacgctggccaccggcggcaaggtcgcgccgctgcgcgcggccgagcaggcggcggacttgtcgcagccggcgacgctgctggccagccccaacgcctacaacccggacggcgtcggcgattccgaggaggcgctgcccaggctgatggccgaggcgaaacgcgaggtgcgcatccagctgttggactacgcgccgctcagcttcggcaagccgcggcaatactacccgctgttcgacaacgccattcgcggcgcgctggcgcgcggcgtcaaagtgaagctgatggtgtcggactggaacctggaaaagccgggcgtcgactacctgaggagcctggcggccttgccaggcatggaagtgcgctatgtgaccattccgcgcgacggcgcctgcattccgttcgcccgcgtcatccacagcaagaccatggcgatagacggccagatcgcctgggtgggcaccagcaactggagcggcggctatatggacaagtcgcgcaatctggaagtagtgttgcgcaatccggcgatggcgcagcgcatcgccactttgcacgagcagacctggtcgtcgccgctggcgcggagcatcgagcccggcaaggcatacaccccgccggacaaggcctgccgccaggcgtcttgagccagattccgcgaggccgtccgcctgcggcgcggatggccaaaaatacgtcaagctcccattcttattaccagtttatccgctctgttccgcgcgtctgtcgccgcgcgggacgtctctggcttgctcggccgctaaaatacattgtcatttgtggctcggcggccgccggccatgcatcccacccacggaggagagaacaatgtgcggcatcgcaggttggatcagctttgagcggaatgtgagggattaccgcgaagtcatcgacaatatgacgcgcaccatgcggctgcgcgggccggacgccggcggcgtatggctggatcgccacgcggcgctgggccaccgccgcctgtccatcatcgatctggaaggcggcagccagccgatgctggcggaggaggacggcaagacgctggcctgtctggtatataccggcgaggtgtacaacttccaggagctgcgccgcgaattgatcgcgctgggccacggtttccgcacccgcagcgacaccgaggtggtgctgcgcgcctatctgcaatggggcgaggcgctgaccgagcgcctgaacggcatgtacgctttcgccatctgggacgcgcgcgccgagcggctgctgctggtgcgcgaccgcatgggcgtcaagccgctctactattatccgctgcccgacggcgtgctgttcggctccgaacccaaggccatcctcgcccatccggaggcgaagcgcgtggtgaaggcggaagggctgcgcgagatgctggatctggtgaagacgccggaggcggcggtgttcgatggcatgcgcgaagtgcggccgggacagacagtcaccgtggaccgcgccggcctgcgcaagcaccgctactggaaactggaggcgcgcgagcacggcgacgacctgcccgccaccatccgcaccgtgcgcgagttgctggacgacatcgtcgaacgccagatcgtcgccgacgtgcccctgtgcaccttgctgtccggcggactggactcttccatcatcaccgcgctggcggcgtgcagcaccgcccggcaaggcaagggcaaggtgcgttcgttctcggtggatttcatcaagcatggggtggagttcgcctccgactacctgcgcagctcgccggatgcccccttcgtgcgcgacttggccgcccatgccggcaccgatcaccaggaaattctgctggaaagccgtgatctggccgatccggcgttgcgcgcggcggtgctgggcgcgcaggatttgccgccggcctactggggcgacatgctgccgtcgctgtacaagctgttcgaggcgatccgcgcccagtccacggtggcgctgtccggcgagtcggccgacgaggtgttcggcggctaccgctggttccacgacgccgccgcggtggcggccgacacctttccctggctgtccggcgccaccgcctccttcttcgacggccagtcgctggtatcgccggatttgctgcggcagctggacatggcgggcttccgccgcgacagctacgcgcaggcgctggccgaggtgccgaccctggcctcggacgacgccaaggaaaagcgcatgcgcgaaatcagccacatgcatctgacccgcttcgtgcaggggctgttggaccgcaaggaccggatgagcatggcggtagggctggaggtgagggtgccgttttgcgaccaccggctggtggaatatgtgttcaacgcgccgtggcggatgaagaatttcgacggccgcgaaaagagcctgctgcgcgccgccggcaaggatgtactgccggactccatcgttcagcgcgtcaagagcccgtatccggccacccaggatccggcatatgagcaggcgctgcgccagggcctggcgcgggtgctggacgacgccgccgcgccggcgctgccgctgctggaccgggccgcggcgtggaagctgctggaccggccgttcggcaagaccagctccgcgccggagcgcgccggactggaaatggcgctggggctgaacgagtggctgcggcaccatcgggtggtgctggatttataaggccgcggccacgccgggcgatgtcgcccggcgtggccattcccaagagaagggggctggctgccatcccaagcgcagagccccgccttggcgccataggcctcccgcgccgcggcgcaaatcttcattttgtcggtctgttctcatgcctcccaggcctgactgcccgccgcttggcggacgatcgcgcatgccgcccccattcccgttgcccatgcggcgcaaggcaaggctcggctggtctgcgtcgaaaggctttgcgcgtcgccaacggcaagccgtggatcctgagttctgcaatatcgcccaggcgcaaactgcgtggcgatgggcatccgcgcagatttccgctgcttcaggcatcggtcttcggcgcatgccagccgccggactgggatcggcctggatggaaagcggcatcagaacgccatgccagcggcggttggttgcaacgggcaagcttaggcttcattcggaatagcaatggcttgggtgttgtgtcgaattccgattggcgagtatcggatcaattgagtcttgttgctcgcgtgtggctgggatgcttgtctggggaggggcgtgacgcgttcacttggggataggcagtaggatgcaacagtccaggttgttgtcatactggcttatactattgtagtatgcatatatatttaattatgataatgtatttgccaattgcggtgagtggaatccgaacgaatttcgccggcaatgccttcccgacggaaccggcctctgacagcaagcccgaccgacgcgcgggaggtggcggcagtaaacagatgccagctaagtggccaggaaaacgactggctgacattgccctcatgcattgcgtcagcagtctgctccatagattcaatctattcctatattttgcttacattcttgagcgcgcggtgtgcctgagtgtggattgcgctcgggtattgtcggaggcgaagagagtgacaggcatggctgctgcgcgctgttctcgatactgatctgttttatgaaaaatatgatatgaaaagcaaaaaaatactcagcgtattgttaggattgatggcgattatttcatcgcaatggtccttggcggataatgacaatggcagaaacctatattcgcagcgatgcgcaatgtgccatgggtctgatcttaaggggacggggccgttggctaataaaagcaatccaccgacacccgatattacaacgccagccttcaagagaagattagcagcctacccgggggttatcgtgtcatctgtgatacttcggcccaatggtgatctaattccaaaaaccttgcaagagaatggtgtgagactgtcgccgtttgcttggagaattaaagatttgcgtgatttgaatcagtatatgagtggcgttattttaaaaagtcgatgattttaaatcaagtgattgaagcgtaacgcgaagagccgtcatgtggatggttgcaagtaaattattcagcgaagagttaattggatatttggcatggtcagtagtgtttgcagaaggttctacaaattttctaacttaggttgataagctcatgcggacaaaggttgcaatcataggtgcggggcctgcggggttaatgctggggcagcttctttctttggcaaatataagcaacgtagtgattgagaatcgctctagagattatgtggaaggccgaagccgcgcaggccagattactcctgccacggtccagattcttaccgaaagcggtgttggcgcgagaattcattctgaaggaatggtacattctacgctgcagtttcattatgaaggctcgacgcgtgagttgaattttcaagcgctaactgggcgcacggtgactatttatgggcagcaagaaattatcaaggacctgattgccgcgcgcttgaagacggaatttccactgctgtttgacgctgcagatgttcagattcatgatactgacggattttcgccatatgtttcattttcgcatggcggtgagcagcagacgctagagtgtgattttatcgtcggttgcgatggcttccacggtatttgtcgaccgcatatctcagactctctcacccagttttcgtacaactacccgtttacttggcttgctgttctggctgaaatgtcgccgatttcgccggacgtcattttttccagtcacgagacagggcttgcattatttacgatgcgatcgccgaatgtgtcaagaatctacttgcagtgctcgccagacgaagaccccaatgagtggtctggttcgagaatctgggatcttttgcaattacggttggaaggcaggcctgagaaggtgaatggcggggcaatcattgagaaaagcattgtgcaacttagaagctttgttgctgagaaaatgcaaaaaggcaggctgtttctggctggagatgccgcgcatatcgttcctccttctgctgcgaaagggctgaatctcgcggtttccgatgcgaatattttggcccgcgcttttgagcagcactatggcaaaggcaaggaagatcttttgttgtcttactctgatatcgcattgaagcagatatggcgggatgtacagttttcccattggatggccatgttgttgcatcgtttcgatgacaactctcattttcatagacgtctgcagatagcagagctggatagggtgcttggctctgggccagccgcgcagagtttcgctgaactatgggttggcaatccgccattcgccgcgtcgatttaaatatagaattgcgccatggatcaaacacgaaaaattctgattgtcttgcatcaagagcactccacgcctggccgagttggtttgctgttgcgtcaactgggattcgagcttgatatccgcaggccacgatttggagatcttctcccgcagaatatgcgggagcacgatggtgcggtaattttcggtggtccgatgagcgcaaatgatagcgatgcgtatattcgtgaagaaatcaattggctggataagccgttgagtgaagggaagccgttgcttggcatttgtctgggtgcgcaaatgctgacgcggcatctgggggagcgagtatatcagcttgataatggaggaattgaggctggttattatccgatagcgccgttgccggcggcgcacaggataaccgaagacgcatgtgccccctttccggactatgtctatcaatggcatagcgaagggtttgacttgccgacaggcgctacgcttctggccgaaggctcaacctttccaattcaggcatatcgatatgggcataatgcctacgccttgcaatttcacccagaagtgacttatgagacgattgatcgctggtcgtcgcgtggaaccgagcggctcaaagcgcctggtgcgaagcccgcatgcgagcacttgactgattggcatcaatacgattcagccgttgcggcctggatcagcgcgtttctgccaaagtggatagcatcgccagcttgaagccgcgcgactgtatagggactgatgcgcaatatcatcgctaaattgctggtataaaaattataaaaaccaatcagactcatattttcatcaaatatgtcggctaggaatgattatgaccaccacctttccgtttcaagaagatgaatgcttttttttgatgcgtcgcaaaaatgaaccaacagtacttgcatgcacaggaaaggtagagaggtttcgccatttggcggatattcccatgaagtctgggctagccgatagccatactttcgattcagtcaacctgattccatttgctcaagcccgagaacgtggctttcctgtgcatgatgatggggagcctatcgtttctctgcaaatcgagaattcgcaatatttcccgctcagccagtttgtcgagatgctacccaatgaacaggtggacatttcaaatatatcgttcactaccgatcaggctgaatacgaagccatcatcagaaatatcatcaactgtgaaatcgggacggggcaaggcgcaaatttcgtcatcgcacgggaatgcgtcgctcacatcggcaatgctgagctgagtggcattctcagtattttccgttcactgcttctgaatgagttcggcgcttactggactttcgctttctatgatggagagcattattatcttggcgcatctcccgaacgacatatttcggcttcgtgcggcgaggtcatgatgaatcccatcagtggcacctatcgtaaaaatagcgcatatgaggtggcggaaagcgagaaggattttctggaattccttcaggacgagaaagaaattttcgagctcttcatggtttgcgacgaagaactcaagataatgagcgagatttgcgatcaaggcggctcggtgatcggccccatgctcaaggaaatgtcccgcctgattcataccgaatatctgttggtaggcaagacggacaagtcgatcatcgatctgctgcgtcgctccatgtttgcgccgacggtcaccggcagtccggtgctgagcgcatttcgcgtcatccaccgatacgagaagcaatccagaggttattacggcgccacgatcgccctggtcggccgcaataaggatggcagcgcgacgctggatgcgccgattctcatccgcacgcttcaaatagaccgggcaggcaaggcggtagcccgggtgggcgccaccttggttcgcggctccaatccgatgcatgaggtgtgggaaacggaaaccaagattgcaggtttgttcaacgcggtccgcaatgcaggcaagagtccggcacctcccgagcgcttgttggacaagatggatcatgagcagattcaaagactgctgcagtccaggaacgcgtatctatcccgcttctggttcgaatcgcaagacgcggacttcggaacggagccatcgttgcgcggaaaatccgtcaccatcgtggatgcggaggatgatttttcggtgatgctcaagcgtctgctggagcagcttgagatgcaggtgagcttggtttccttcgccgactacaaccctcagcttcatcagagcgatctgttggtggcgggacccggcccaggcaaccctctggatagccaggatggcaagatgatgcgcttgcgcaatataatcgccgcccgcttggagagtgggcaagcgatgctttgtgtttgcctgtctcatcagattctgtgcgacatccttggctttcccgtgatcaccaaggcggttcccttgcaaggcacgcagcaagtgattgatttgttcgggactcagcagcgagtgggtttctacaatacttacgtcggattggctacgcaaacgctcgagcaagtcagggtggcgagcgatgaggaatcgcgcgagatacatgcgttgcaaggcgagcggttcttcagcgtgcaattccatcccgaatcgattcttacacctcacggtttcgagctgacgcggaagatattgagccggctcttgctgacgcgtcagtttgaagacagggaaaggccggttttgatcggcgatgccgttctgtgatctgagcctgggacgtgagcgctcagcgcttagccccaggcttgcaagtcgaaatctccgcccgcttatgcaatgaaaacctgcccccaaggctgggggcagggcggctttcactttagcggggtatcgacaaactcaggcaacagttcgacttggtcggcataggctgcaagcgcggtataggtttggacatccaccaagtgggataccctgaattgggtgaaacgccaagccgcggccacggtgacatcggcctgagacagctgcgcggtggcaagccaagggtttgcttgggccgcggcttcttccagaagcgccagcgcggcatgcaattgttcggttatgcggcttagccaaggagcatattgatattcgccgggcttgttgtgctcatattcgagttgaacggctttttcgcaaaccgtgaggccaagtccgatcagcgacagcacctttctgtgttgtttcgagtcttttggcatcaaactgcgggaggggtcgacccgtgattccagatagtcaatgatcatcgacgaatccatgatcatttcgccgtcatcgcagatcagcgtcggcgccttgaccgccggattgatggcgcggaactcatccacattgcgaaataccgagatttgccggtgctcatgctctaaacccatcaagcgcaacgaaattgccacgcgccgaacatagggtgatcccatcatgccaacaagtttcatcaattccccctgaggttttaatcgttcgcttttccagtcgacccatttggagtcgaaggtaaagaagaacgagtgttacatgaatacgattacgtaattaactacatgtcgattttagaaaattcaacctttgagttgtagaataaagaggcgcgttccgaaacggtttcagcatcacctgtcgtaaggaattggttgtctccgattctggtgctggaaaaatgcgggtttctttttaagtactcaagcaggctctgggcgcaagcgtccggctgagagatgatgcgcatggaatccggcagttctgttcgccatatatgctctactatcgggtaatgtgtgcaagccagtacgcaaacgtctggaacttcctggttggcattaaatagcgcgttgatgtttttccgaatttctgcccgcagcacggcttcaggcgcggcttgttcgatgagcagggcaagaccattgcatgcttgttggcgcacgtttatgccggggtttctgctgttgatttccgccgtgaagatattggattgcacggtgtgctgcgtcgcgaatatcgcaacgctcttgaccgggcgatggggatgagcgcgcgtgctgtcgaatttccaatcccaaggagtggcgatgatctcctcgacagtgggtacgacaactccgaccgcgcgccgacctgggtacgcttggggcagccatgtctgctgaatctttcggaggctggtggccactgcagtattgcaagcgatcaccaccagtgagcaaccatgctcaaaaaggcgggcaagagccgcttgtgtcaagtcatagatagcatctgctgagctattgccatagggtgggtttccgtggtcgcctaaatagacgaacttctcattgggcaaaacggattcaaacgcgcgcatcaccgtcaagccgccgctgccgaaatcaaatacgccaatcaaagccagcctcgcttatctgctcgtgttgttaaactgttgcgatgagctatatcgtggttgctatcgcaatggcgacgccaatatataaaatgcccgtgactaggctcatttgacgttttgtcttgaatattttcgccgcatggcgagccattaacatgtatagcgcgtataccgatgtggaaatgaagatcgctgttgccactaatgcaatgcactgcggcgcgtatgatatattgttatttatgaatgtcgggaacagtattatattggtcaatatccctttggggttcgtgaatgagacaatgacggcgccggtaaacatctgaaaaggtgtgcgcttgcttgagcttgcaaccgcaatttgggagcgcgagcgtagcgatttcaatgcaaggtagagtaggtaagcaacccctatccatttgagccagaagaagatgccaggattattcttgacaagtatgcctaggcctgagaggacaatgacggcgtggcccccgcttgccagaccaaaaccaatggcgccgggaaaggattgtttaaaaccattatcaagagcttgcgccatagagaaggcgacattcggaccgggtaggatggctgccgagagaaatacgacgcaaaacaacatccaaagttgaaaatccatactgcgctatccttgtatagctgtcgaatcccagatgattccgaactggttgaaatcattcatcaggggagaggcctagttactctgcacgcattcacaaagtcggtacagcagccggtggaggcatggactcagtgagttgccgcattcagtcactgaatgagcgccaagccagccctggcgttttggcagccttgcccctcatttggtctcttggtcctgggggcggcaacgcgccagctgcttggggtggccgttgacagcggcgttgcgcgggcactgcatccacctaaaagacattatcataattaaatatatatgcatacaacaatagtataagagtccgtgggggatccattgcctgtagcgccggcgcgccacctcacggcctcggctcctttttcaggaggagtcgcagattggcggatcagcgggcgagcgttgaggcgcgggggcgcattcaggatggctgttgtgctgcgcgccttgccgcggcgggttgagcgcgacttctgacggcgggaggcccgagaccatcttgcgcgatatggaatggcgccgcgatcccgagcgctttcccatccttgggcagaaggcggcaaggacgggaataagggcgcggctgcgcgaccggcggataacgcggcgggtaaagcgggggacgctaccggggcttgtctgtcaggcttatcgcttgccaaaccgcagtcgcagccaccgctagcgcggcggccgcaccggacggccctgcagcggcgtggacaggatgatggaggtgcgggtttcgcccaggtcgttgagctgggacaccagttgctccaggtggccgacgtcgcgcgccagcaggcggaacacgtaggagtcgacgccggtgacgtggtggcattccatcacttccggcatcgcttccagccgagccagcagcgtcttcttgtctggttgcggcacggtgatgcccacccatgccgatagcgcgtagccggcgcgtaacggcgccacacgggcgtggtagccgcctatcaccccggcttcttccagccgcttcactctttccgataccgcgggcaccgacaggcccaccgcctgcgccagttcggtcagcgactggcgggcgttgtcctgcagcgcggccaggatagcccaggattttgcgtctacttccattcgtaaactccttctgccgttttgcctcagatttaaaagccagcatagcgtctaggcgaaaaaaccgcatgggcagtcgcgcggcggggcggcacactatgagcatggattaaggggaggacgaacatgttctggcaggcggctttgataggcttggcgattgcggcgccgatggggccgataggtttgttgtgcgtcagccgcactctgcgcggcgggccgcggctgggcctggccaccggcctgggggcggccagcgccgatggcctgttcgcaatggccggcgtcgccggcagcggcgcggcgctgcatctggccggagcgctggcgcggccgctggcttggggcggctgcctgctgttggcgtggctgggcgtggccacgctcaggcggccggaaagccagccggcggtgcgggaagaaggccgcgtcgggctgcggcgcgcttacgccggcgcgctattgctgacgctgagcaatccgatgaccatcctgtccttcgccgcggtggcggccggcttgtcaggcggcctggccgccagcggcgcgcagcagctggccattgtcgccggggtgttttgcggctccgccgcgtggtggctgatattggcctatggcggcggcgccttgctggcgcggctgggcgcgcgcggccgccgcttgctggacgcaggctgcggtctgctcttgctcggtttcgccgtcttgctggcctggcgcgcggcgggcggctgagcgggcgggcgagaaaaaggcccggacaagccgggcctggggcagggagaaggcgcgcttatagcttgaagtggctgaccagttgctccagtccgccggacagctcgcgcagctgcttcaccgcctggctgacctcgctcaccacctggttgttgttctgcgccatgctgctgatgcgctcgacgttctgcgcgatttccaggctggcgctggattgctcgcgggtggcggcggcgatgtcgacgatgctggtcaccagctgctggttgtagccctgcacttcgcgcatcgcctggttggcttcttctgcgatgccgacgctcagatccacctgctggctgctgcgctgcacgtcgccgaccgcctggcgggtttcgctgctgatggcctcgacgatgcgggtgatctggacggtggcctcggcggtgcggccagccaggttgcgcacctcgtcggccaccaccgcgaagccgcggcccagttcgccggcgcgcgccgcttctatcgcggcgttcagcgccagcagattggtctggtcggcgatgtccttgatcacgccgacaatggtggtgacttcgttggagcgctctcccaggccgctcatccgttccgccagctcgtgcatgctgtcggtcatgcgctgaatctcgctggtgacgcggttgaccttggccacgctctgctcggtcatcgcgccggtttcgcgcgcgatgtcgccggcttgctgcgcggtgctggcgatgtgctgcgcgcccaccgtcacctgttcgacgctggcggcgctggcggtggcggcgtcggactgctgggcggaggcgtcgtgcacctggccggccgagtggctgagccgcgcggcggcgtcggaaacctggcggctttgctcgcgcacattgacgaacatgtcgcgcaggctgtccagcaggcggttgaaggcgctggcggtgcggccgatttcgtcgcggttggcgatggcgatgcggctggtgaggtcgccgccgccgctggccagctgctccatggtttcggccaggtgctgcagcgggcgggtctgggtgcggatgacgatggccagcagcagcaggatcagcgccagcgccaccgcgccgatggcgatggcggtgagcatttcgcggcgggcgccgtcggtgagggcggcggtggggacgctgatgcccagcgtccagaactggccggtgtcgccgatcgcgatggggtggaagaagtgagtgaagccgccgtcttcgtagacgaaatcctcgcctttcttgatgtcggccagatggccggccagcgcgtcgtccttgcctacgtttttgcccagctgatccgcctgcgggtggaccacgtagacgccgccttcggacaggatgcggatgtagccggtctggtacaggcggatctggccgaaggacttctgcagctggtccagcgccacgtcggtggcggaaacgcccagcatcttgccggcatcgtccttcatcaccaccgccagcgagctttccagcaccttcttgccctgcacttcataggggtagggctcggtgatggtgtcgcggccgcgctgtttgggcacgtagtagaaatcgccccagcccggcttttcatagtcgggctgataggtttgcggatggtccttgaacttggggaagtccttgatgcggtcagcagacatcatcacgtccatctgcgccttgccttgcgcgttgcgggtgatgtagggctggtagcggccggtggggtcgtggcgcggccaatccagccggtaggggttgtcgtcgccgtcgaaggcgttgggttcccacagcatccacagtcctatcgactgcggcgcgtggtccagcatctgcaggatgatgttgtcggtctgcttgcggtcggccttgccgccgcgcttgatgccgacgacggcgtcggccaggtggcgcggcagcagaaagccttggctgagggtgttttccgcgtccttggcgtagctgccggcctgctccgaggccagctggtagccggtgtcgatggcggacttgtagttgagatgggcgatcagggcgatcatggcggcgaaggcgaccgttatggcgccggccgccaccaggatgatgcgggtactgaggcgtccccattgttgctgcgcgtgactcatggcgattacctgcgaggctgctggttgattcgagtgctgcacgaaaccggactaatacgtataaattcgtatttaaaacgaatataccggcatcccgcccgcgcaggcaatgacctgcggcagtggcggagcgggtaggacgaggcggcgagaaggggctgggcgaaaaacgggcggccatgcccggacgatcggacatggccgggagcggcgcgtcagaaggtcaagacgtcctgttcctcctgataggacatgtcgccaggctcgccgacgatcagcggatcgggcgcgcgcgccacgcgcgggtctttgccgggatagtccagccgcgacagaaagtggcggatgcagcccagccgggcgcgcttcttgtcgtcggacttcaccaccgtccacggcgcgtcgccggtgtgggtgtggaagaacatcgcctgcttggcggcggtgtagtcgtcccacttgtccagcgactggatgtcgatcggcgacagcttccagtgcttgagcgggtcgtcgcggcgcgagatgaagcggcgcagctgctcctcgcggctgaccgaaaaccagaacttgaacagtttgatgccgctgttgaccagcatccgctccagttgcggcgtctggcgcatgaattccaggtactggtgggcgttgcagaagcccatcacccgctccaccccggcacggttgtaccaggagcggtcgaagaacacgatctcgccggcgctgggcaggtgggcgatgtagcgctggaagtaccattggccgcgttcctggtcgctgggcttttccagcgccaccacccgcgcgccgcgcggattcaggtgctccatatagcgcttgatggtgccgcccttgccggcggcgtcgcggccttcgaacaggatcacgatcttttgtccgctttccttgacccagctttgcactttcaacagctcgatctgcagctcctgtttcagcctttcgtattcggcgcggcgcatgcggctgctgtaagggtagctggccggcagctcggcgctgccgctgtcctcgtcgctgccgtgcggcgccagcgccacctgcagcgccaccggctgctggctggtttcctggatgatgtgcaccgattcgtcgtgcgcgcgcgccacgttgcggctgcgcgccgactggcggcgcggcttggccgcagcggcgggcgcgtcgccggcggcgggttcctgggagtcggggggatcttgtcgctgcgtcatcgcttcaccttaatccatggtcttggcatggtatttatcctacgccggcatgggcggggtgtcgatgcggccggcgacggccaggcgcgcttcgcgccgcctggcgccgtttcgtcgcaaaacagcacgtgggcatgccggctggtttacagtggcggcgtggttttcattcagggagagagtcgatgtggtcagtgcagatgcgccaggtgcgcaagcattaccggctggaccaggtgacggtgccggcgctgcaggatgtcgagctggcggtgagaccggcctgcttcaccgtgctgtccgggccgtcgggcagcggcaagaccacgttgctgaatctgatcggcggggtggaccagcccgacagcggcgaaatcctggtggcggggcaggacatcgcccggctgggcgacgatgcgctcagcgatttccgcgcccgccatatcggcttcattttccagaatttcaatctgctgccggtgctgtcggcgtatgaaaacgtcgagtatccgctgctgctggccaaggtgccggccgccgagcgcaaggcgcgcgcgctggccatgctggacgcggtgggcctggccgacaaagccggcaaccgccccggccagttgtccggcggccagcgccagcgggtggcgatagcgcgcgcgctggcgcaccggccgtcgctggtgctggcggacgagccgaccgccaacctcgacagccagaccggcgccagcatcctggcgctgctgcgcggactgcagcagcaatatcagttgacggtggtgttttcctcgcatgatcctcaggtgatcgccgccgccgacgaccattaccaggtgcgcgacggccgcgtcagccacgcgcccgccatctcccgcaaggagccggcatgaataccctgaaactggcctggcgcaatctgctgcgcaaccgccgccgcacgctggccacgctgggcaccatggtggtgggcgtggtggcgctgctgctgttcggcggctacaaccgcaccgtgcaatacggcctgcaaaccagcttcgtccgcggcggcggccatttgcagatccagcaccgcgactacttcctctacggcaacggcaatccggcggcctacggcatccgcgactaccgccgcgtgatgcgggtggtggagaacgacccggtgctgaagcctatgctgatcgcggcgacgccgacgttatcgttgggcggcatcgccggccattacgccgccggggcctcgcgcaccgtcatcgcccagggcagcgaagtgacggggcagaacctgatgcggcgctgggacgactaccatttcggcgacaagcccaaaaccgtcgccctcaccggcagcgcgccggacgccgcggtgataggcgtgggcgtggcgcgggtgttgcaattgtgcgacgcgctgaaagtgaagggctgcgccgcgccggccaaggctgaaagcggcggcacggcgatgccggcggacctgcaggcgctgtccgacgccgcgccgcaggcggcggccgacaatcgcatcgaactgttggcggctaccgccgccggcgcgcccaatgtggcgcggctgaccgtggtgaaggcgcagagcatgggcgtgaaggagctggatgacatgttcgtcagcatgcatctgtccgccgcgcagcggctggtttacggcggcggcgagccgcgcgtcaccgccatcgcgctgcagctgcaacacacccgccagattccggcggcgcaggcgcggctgcggcagctgttcgccaccagcttgaaggaccagccgctggccgcttacgacttcgccacgctgcagccgcaatacggccagatcaccggcatgttcggcaccatcttcggttttctgtccattttgatcggctgcgtggcgctgttcaccatcgccaacaccatgaatatggtggtgctggagcgcacggtggaaatcggcacgctgcgggcgatgggcctgcgccgcggcgggatccagcggctgttcctgtgcgaaggggtgatgctgggcatgttgggcagcgcggccggcatcgcgctggcattgctgctggcccagctgatcaaccacgccggcttgacttggctgccgccggggcaggtggacccgtctcccattctagtgaggctgtggggcgaaaccggcatgatgctggccaccgcgctgggcctgatgctgatggcgacgatatcggcctggtggccggcgcgtcgcgccgcgcgcgcggtgatcgtggacgccctgcgccacgcctgaggagaacaagatgaaaaacatgtggatggcggcgctggccctgctggccgggctggcccaggccgcgccggacgcgcagaccatactggccaacagcgacgcggtgcgcaatccagacaaatccttcggcctgatcgtgtccctggtcagctacaaggacggcaaggagaacgaacgcagcgcgctggcggtgtattcgcgcgccgacccgcgcagcggccagttccgcagcctgctgcgcttcgtcaacccggcgcgcgacgccggcaagttgatgctgaaaaacggcaacgacctgtggttctacgacccggccagcaaggccagcgtgccgatctcgccgcagcagcgcctgttgggccaggcgtccaacggcgatgtggtgacggtgaacctggcgctggactaccaggccgcgctggccggggaggaggacatccaggacggcgaccgccagacgcgccattgctacaagctgcggctgagcgcgcgcaaccccggcgtcacctaccacgcgatagagctgtgggtggacaccgccggctaccgcagccgcaaggcccgttttttcgccgaaagcggcggcctgctgaaaaccgcctattaccgcgcctatcagccggtgctggggcagcagcgccccactgagacggtgatcatagacggcctcaatcccaagtgggtgacggtgctgcgcaacagcgacttcgcctggcgcgaggtgcccgaagcctggctgcagcgcgactacctgccgcgcttccgggcggagtgagcgatgcggctgagcatgttggcgctggcgggcttgctgtgcggcccggcctgggcggacgacgacgcggcggcgctgcaactggccgatcaggccagcctgccggcggaaaagccgcgcgacctgaagctgctgctggaggcggccgccatcgccagccccggcgggcagcggttgtcggtcgacctgcgctgggacgggcggctgggtccgcagtggcgggcggtgttcgccgaccggctggaccaggatttcgccgactcgccgcagcgcggccacggcgtcaataccttgaaggaggcgtatctcagccatgagttcgacgccgccactatgctggacgccggccggatcaacacccgctacggcgtcggcgtcggctacaacccaaccgactttctgggcgtgggcacggtgcgttcggtggtgtcggccgatcaggccagcctgcgggaaaaccggctgggcaacgccatgctgcgctggcagcggctgtgggacaacgcctcgctgaccgcgatctggtcgcccaaactggccgacggccccagcggccacggcatgagcctggatttcggcgccagcaatccgcgcgagcgggccttgctggcgtacagctaccgcttcagcgaggcgctgaatccgcagtggctgctgctgcaggagcagggccgctcgccgcaactgggcttcaatctgtccagggtgttgggcgatgccaccgtcgcttatgtcgaatgggccggcggccggcaggcgccggactggcggcgatggcagggggaggcggacgacagctggaacaaccggctggccagtggcctgacctggaccggcagcaacaagctgagcctgacgctggagggcgagtacgacggcggcgcgcctgggttggacgattggcggcggctggcgcgcagcccgttttaccgactgtaccggatgcagatggcgacaggcggcgtgttgccggcccggtgcgccgcgctggcgcgcgccagctggcaggacgcgttgctcgataatctcgacctgacggcgatgcgcgccgccagtctggacgaccatagcggcatgaactgggccgaggcgcgctatcatctgggcccggtcgatctggcgctgcagtggcagcgcttcgacggcggcgccttgagccaatacggcgccgggctggccaagccgtcctggcagctggtgttcgattatttccattgaggtgacatcatgaatgcaagccggcgctggtccgacgaagcgcgcgaactggctgtctgcagcgcgatcaacctggccatcggcctgtttttcgccgcgctgggcggctggaagatggtgtatgacaacctgctgatctcgttctgcatcggttactgctgttggctgaccggcaccttgctgggcggctggcttcagctgaaccgcatcgcggtctgcctggcggtgttgctgttcagtgtgccgttcggcttcaagctggcgacgtggctgggcgctttcgatgtgctggcgcgcgctttccgggtgccggagcgcgcctacctgttcttgctgcccaccttcctggtggcgaccggcgcgatgacggtcagcatgctgtactaccgttcgcgggcgctggccggcgaactggaggccacgcggcggcgcgaggcggaaagccgcgccgcgcagaccgcggcccaactggcgatgctgcaggcgcagatcgagccgcatttcctgttcaacacgctggccaatgtgcaaagcctgatcgagctggacccgccgcgcgcgtccgagatgctgcggcacctgaacacctatctgcgcgccagcctggagcgcagccgcaatgccgacggcaccctggggcaggaactggagctggtgtcggctttgctggacatcgccgctatccgcatgggcgcgcggctgcgggtgcggatggaggtggacgacgcgctgaaagccttgccgttgccgccgctcttgttgcagccgctggtggaaaacgcgctgcgccacggcctggagcccagcgtggccggcggcgagctggcggtgttcgcccggcgcgaaagcggcgtgctgcgcctgggcgtcagcgacagcggggtgggcattgccgaattcgcgcccgccggcgtcggcttggccaatatccgcgagcggctggcggcgctgtacggcccggcggcgcaattgcggctgacgccgcgccagcctagcggcgtgctggccgaactgctgttgccgatcgcataatcatgtttttcccgacagaaagcttacgatgcccaccgcgctgatcgccgacgacgaaccgctgctggccgccgcgctgcaaagcgcgctgaaccgcttgtggccgcagttggacattgtcgccatcgcgcaggacggcgcggcggcgctggccgccatcagccggctgcggcccgacttcgccttcctcgacatccgcatgcccggggtggacggcatggcggtggccaggagcgtgtccggctgcaaggtggtgtttgtcaccgcctacgagcagttcgcgctgcaggccttcgaggccgaggcggccggctacctgctcaaaccgctggacgacgccaggctgctgcgctgcatcgcccgcctgcaggccggccatcaggcgccggcccctgctttgccggctgccagggccgaggccgagggctggctcaactggatcaccgccggcctgggcaacagcaagcggctggtctcggtggacgaggtgctgtatttcaaggccagcgacaaatacaccgaactggcgctggccggcgaaagcctgctgatccgcacgccgctgaaggaactggccgcgcggctggacccggagcgcttcgcccagatccaccgcggtctgatcgtgcggctggctgcggtgcggggcatagagcaggacctgctggggcgcagcacggtcttgttgaagcacggcggcggcagcctgccgctcagccgcagcttcgccgccaggttcaaggcgatgtagcggctatttcagcagttcgaagattttcggccgctccggctcgccgtccatatgcggcgcctcatgtgaaggaactggccgcgcggctggacccggagcgcttcgcccagatccaccgcggtctgatcgtgcggctggctgcggtgcggggcatagagcaggacctgctggggcgcagcacggtcttgttgaagcacggcggcggcagcctgccgctcagccgcagcttcgccgccaggttcaaggcgatgtagcggctatttcagcagttcgaagattttcggccgctccggctcgccgtccatatgcggcgcctcatgcagatagccgacccgatgcaggctgcgcaccagcgtcttgccgctgtccgggtagaagcagacctcgtgcggatggttggcgccgacgccgaggtagaccagatcttcgtcgaagggattggccaattggtgggctacgccggtgccggccggacagcacaggcagtcgccggggccgacttcgcaaacctggtcgccatagcggaacacgccgcggcaggacaagctgtaaaacagctcgtcggccagcgcgtggctgtggaaagggcagccggcgtggccgggcggcaggcgttggcgcccaactggcccttggcgtcatccatcgccggcgtcagcggcttgtagccgccgccccagtgccggccttcctgatagtttttttcttcgacatcgttgaggttcacgacattggcgggtcgttcgcctaggcggctctccattgggttcggccgcgtgcggcgcatcgccgcttcggctacgctgacagcatacccgtgccgccgatggaagacatgccatggccagtcccgcgttccgtccccgcctgctcgacagtctgaagcactacaacagccagttgctgcgcgccgacctgatggccggcgtcacggtgggcatcgtggcgctgcccttggcgatggccttcgccatcgccagcggagtgacgccgcaggccggcatctgcaccgccgtcatcgccggcttgctggcggccgcgctgggaggcacccggctgtgcgtgaccgggcccaccggcgccttcatcgtcatcctgtacggcatcgtcagcaaatacggcgtggccaatctgctggtgtgcactttcatggccggggcgatgctggtgctgatgggcgtattccgcctggggcaggtgatacggtttttcccgatgccgctgatcaccggcttcaccaacggcatcgcggtgctgatcttcctcacccagatgaaggatttcttcggcttgcccatcgccaggatgccgtcgggtttcttcaacgtggtgctggcgctgcgcgggcatttctccgcgctgcactggcccaccaccttgctgtccgccgcgctgctggccttgatcctggcgtggccgaagcggttgaaccgcatattgccgtcgcccttcgccgcgctggtgctggcgaccgcggcgactgcggctttcggactgccggtggccacgctgggcagccgcttcggcggcattccgcaaggactgccggcctttgccggactcgatctcagccccgcccacctgtccgacttgatggcgccggccttcaccatcgccttgctgggggcgatagagtcgctattgtgcgcggtggtggtggacagcctcaccgccgaccgccacgacgcaaaccaggagctgatagggcagggcatcgccaatatggtggtgccgtttttcggcggcatcccggccaccggggcggtggtgcgctcggtgaccaatatcggcaacggcgcgcgcacgccgctggccgccatctttcacgccttgctgttgctggcggtgctgctgctggccgcgccgctggccgcccacgtgccgctggcggcgctggcggcgattctggtggcggtggcgctgaaaatgggcgactgggacatccgcaaggcctggcggtttccgcgccacgataccgcggtgctgatcctcaccttcgtcctgaccgtgattttcgatctgacggtggcggtggaaatcggtctgctgctggcggcggtgtttttcattcgcagcatggccagccatacctcgatcaagcagttgaagccggagtacgcgcagctgttcgagcgccataccatcgccggcaaggtcgtgccggacggctgcgccgctttccgtgtggagggcgcgttgttcttcggcgcggccgacgcggtggatgtggtgctgaagcaggcgccgcacgagcgggtggtcatcctgcagctgcatcggctggtgttgctggacgccagcggcctgctggcgctggacgcgctgcgggagcggctggcggagcaaggcaaaaccttgatcctgtgcggcgcggcggacgaagtgatggacatgctggtggggtcgaggctggcggagcggctgggcgcggacaatctgcagcccgacctggtgtgcgcgctggcgcgggcggagcggcaattgacggatggcgtggtgtggggctgaggccgggcggcccgccgccgcccggcgccggcgtcacttcccggcgcttttttcccggcgcaggcgcagccagcggtacagcgcatgcgccaccgaaaccggcgacagcggcaccagcgccatcaggccatcgccctggctgtagccggggttcatgctgaggaagaagcgggtggacggcttgctggagctttgccagaactggtggtcgtccttgctgtcgcgggtgaggatgcccaggttggcgatgaaggggcggtccggcgacaccggcgtcagttggaagctggagaacagctcgtaggccttggccgccagcgggtggcgctcgtcctggccgggcgccggccacagcttgtgggcgaatttgtgcagcacggcatagctggacgggtgcagcatcacgccgaagaaatacatcggccgcagcgggtggctcagccaatggagcagcacctggcgcaccatgaaggcgaaattgctgttcttgccgcggtattccttgaacaggccggattggacgcgcagcacgctgcaggcgcggcggcctatctggcggcggaagcggtgcatcgcgcagtagccaaccaggcgctggttctcgtcgcggtgcagcagcaggcagctgtgctcggccggcggcgaaaacaccagtcccttgaaggtggggtagtcggtgccggagaagatggcgtcgtgcacctggaacagttccgcggccagctgctctttctgcgcggcgtccagtttggcgggcatgactcgggtggagcggatgatggcggccatttcattcctcgctgttgcattgcagcattgaaatggaggcgatcatagaaaccgggcggcgcagtggctactggcctttttgactatcaaatgtcatttaaattttacacaataaatgacaatgaaatttatggatttatcgatgggagcggcgcaagcaggtcaggatagctgcccattttgccagtgggtgccgcccgcgggatcaataaccttgctggcgctgcacgaggccgtcggcttcgacgccgcgcgccagttgctgcagcttgccgactatctgctccaccgcttcctggcgcagcgtgatggcggcgatgtgcggcgtgatcgcgacggccggatggcgccagagcggatggccggccggcaacggctcctcggcgaacacatccagctgcgcgcagcgcagatggccgttgtcgagcagcgccagcaacgcgtcctggtccaataggtcgccgcggccggcgttgatcagcatcgagccggccggcatcaacgacagccgctcgccgttcagcaggccctgggtctgcggcgtggatggcagcacgcaggcgaccacctggctggtttccagcagtttctccagcccgctttcgccatgcaggctgtgcacgccatggatgtgcttgggattgcggctccagccgctcaccatatagccgtcgtgcgccagcgccttggcgacggcggcgccgatctcgcccaggcccaaaatcccgacatgcacgtcttccggcggcttgggcgccagcatccgccattgtccggcggcctgctggcggcggtagatgtccatattgcgctgatagcccagcacgccgtagcggatgtattcgatcatctgggccgccatgccgccgtccagcagccggtacaccggcaggctttccggcaggtcgggccggctcagcagcttgtcgaccccggcgcccagcgcgaagagggcctccagcttgggcaggctggcgatcaggccgtccgggatgccccaggcgatcaggtagcggacggtgtcgggctggatgtcggccaggctgccgaagcgctgttccggcatggcggcgcggaacagctccagataggcggcgacttccttcgggttgggcgtgtggaccaggatcatggcggcgcttctagttggggcatgcttgcagtatacgccgtccaccggccggcctgccaagccagcctagcgcgccgcgtagcgttcgcccagccggcgcatggtgccgatcagcagggtttcgacatcgtcgccgcgcgccagccgctcgctggcatgcggcagcagctgcgggtgggcgccgatcaacaccgaatgccgggcggcgcggaacatcggcaggtcgttgctatcgttgccgaagcagaccagctgttcggcggcgatgccatgccggctcagcgcgctcatcttgtcgacgccggcggcggtgatgtcgacgatctgctggtcggaatggtgatggatgtggatatcgtcgcggccgcgcagcgcctgctgcaaggcgtcgctgtcggcgcattcggtcaccagcagcttcactggctggtggatttcgtcgcgcgccacctggcgggcgcgccgctgcgggtccaccagcgtcatgaagggatggccgggctcgccctggtaatggtaatgccaggccaggtcaaccaggtaggaggccgagtggcgctccgccaggtctaacagttgttgcagggtgtctgcggccagcggggcgatgtcggccagcgcgccgccatgccaggtcatcgcgccgttggagccgacgaacaagccgtggtggaagcgctcgtccagcaaatggagcatgtcgcggtaagggcgggcggaggcgaagcctatcgaatggccttgcccttccagttcggacaaggcgtcctggatggcggggctgatgttggcgccgtcgaagcagagggtgccgtctatgtcgaagatgaaatgcatgagtgtggcgaagggatagggagaatgggcgcaaaattgcttgaatgatttggcaattttacgagtgagccatttttttggatattttagctaaatgtttcatgacgttcgccgatatgggtggggagaatagtatacagggagcatgagaatggcggtaaacggcgggtttcccatcgctttgcggccgcagtcggctttcgccgcggtaagggtggcggcgcctgcgggtgcgccatccaatcccagcggcgcggcgccgctgctggacatcaaggggctggaggtggggacgccagaatcgcgttatggcttcagcatgcaaaccctgcagctgctgaagcagtacgacgtgcgcgatatgtcgggcaaggatctggacgcgctgagcgaactgatgctggcgcgtggcgagatggatggcgatgtcagcggcaccatccgcagcgacatccagggccatggctggaaaaccgccggcagcagcaatgcgctggaaatcttctcggcgcgccgcgacgagaccatggccagcgtcaaggcgggagaagtctcgctgaagcttgccgatttcgacctgaaaggcaatgcgcgggtgacggaggcgctgaacaagctggcgggcatccacgatgccttgcaacacgacgacagcgtgacggcggccgccgagggaggcatgagccaggcggcggacatccagcgcttcgacagctggctgcggcaaaccacgcgctggcgggagttgggcgaggccgagccgcagcccgatgcggagaccatcgacgcggtggggcgcgttttgcagcggctgggcatcagcttggcgggcgagggcaatagtgccgagcggatggcccaagcctggcaagcctatcagggctggcaggcgcagcacccgggcgagcagccgcggatggatttgcagccgccggcggaaacgcccgccgagccgcctcgtgccgcaccggcggctgccgcggtggcttcgacgccggcggcggctgcgaagcccgccagggaagcggcgccgcgcttcctgctggaggcgcagtacgggatgagtttgccgatgctgcaggtgctgaagagtttcgatgtcgccaatgcctcggtggagcaggtcaagcaactgggccggttgttgcaggacaatggcgaactgtcgcaggacgacgccgattcgctgctgccgcttacccagcgcgggacggcggattcgatgaattattaccggcgcgacctgcgctggctggccgattcgcaacagcatggcgagacgcctcagtaccgcactccacaaggcttggtcgacttggcgagcccggccggccgcgcccgcaacgatcagcaggcgcaggcggtgctggaccgcttggccgctttgcaccaggccttgcagggagacgacagggtgcaggaggctgtggacggcggcttgcagcagggcagcgacctggcggcgttcaacgcctgggcgcaggcggagggcaagggcgcgcgcagcggcgacgacgcgcagccggcgttccgcaaccggcaggacgtggacggcatcttccgcacgctgcagcgcttgggcgtggagctgacgccgcaagatggcgccgtttcgcccggccagcggctggaacaggcgtggaaggactaccagggctggcgcgccagccacccggacgcgcagccggggctgaggctggcgccggccagacgcatcaacgattacgcctgatcgccgctctgccggcgcctgcggccctttttctccgctgtcctaggtgcaaaccgcagctagcggccgcgctgttgccgccgccatgccgtgaagctatatcttggtgagttccattgcattcgttttgtctgcatgaaaaacgcatgtcagccgcagcataggcaagccgcggcgcgggaggagtcgagatgataggcgcggacatgcggtatctattgggcgagcgcagtttgcgctcgctgagcgcgctgccgggccgccgcgccgccgccggcatcctggccagcgatgtcgaaggcccgctgttcttgggcgatttcatcgccgaagcgctgtcggcccgggttcggccgcgccactatgcggtggatgccacgccatcctacggccatctcctgtaccaggaaggctacgcggccttcagcgaagccaccgcgggactgcgtcggccccattgccgcaacggctgcgcccaggaggggaccgacaccattttcgccctgcctatgctgctggcctgcggcgcggacgccggctatctcgacttgctggcccgccgcagcgcgccgacgccgggggccgcccggatgctggctgagctggacaggatgggcatgatggcggtgggcatcaccaccgcgccgcaacaaccctaccgcaatctggtcgccgcgagcggcctgctgccgcgggagcgcatcctgggctcgccgtttccgctgaacgaggccgcggagctgctgcgcggccaccggcgctgggatgaggaaatcggcgcggtgaaccgctatctggacgacgctttcgccatcatcgacggctattcggagatttaccgcggcgtggatggccagatacgccgtctgtcggactgcggccggcagctgctgcaagcgcgcttcatccggcattgtcgcgatgagctgggcatcagccatgacccggcgacgcggcgccgccggacggcgcccaccctgctgggcgagatcatcgaggcctgcgcgatgatgggcgaccgctcgaaagcggcgacggcccttaacctggggcgctcgctgcgcggcggccagccgctggtggcgatgggagatggcggcaacgatgccgagatgctgcggcgggttccgttgtcgataggcgtgaacggcccggaagccgccagcgcggccaagataggcgtggtgaccgccgacatggcctgcgtgctgcccatcctgcggcagatgttgctgggcgagcgggatatcgacgccatcatcgtccgggcgcaggccgaggtcggcgacgccgctttgatccaccgcggcggcggccgcctggcgccggcgctgttggcgcggcaccgggagatgaaacggcagctgcgcggagccttcgtcactttctgactggccgccatgtccgagcccccggtccattccttgccccaacccgcctgccgggctttgtcccggaagccggccggcgttgtcgtccgccgcgatgggcgattgctgctgggcgtgttgtcgggcttgttgtccatggtctgcgtgcagttgggatcggcctggtcggtgccggcgatgcgggagcaaggcccgtacgcgctgacctggctgcggctgtgctgcgcggccttggcgctgctggcttgggcgcgcccgccgctatggcgtttgctgcgcgctcatggcggccaactggcggccttgggcgcggcgatggccggcatgatgctgtgttttttcgccgccatccgcagcatgccgctgggcctgacggtggcgatcaactttctcggccccttgctggtggctttggccggcgcgggccgccggttggcgctggcatggccgccgctggctttcttgggcgtgggattgctggcctggcatggcgggcagtggcagggcgatgccgccgggttggcgttcgcctgcggcgcggcggtctgctggggggcttacatcttgctgatgaagcgggtggggcggctgggcggcgggctggatgggctggcggcctccatgctgatggccgccttatggtgcgcgcctttcggcttggccggcctgcatggccgcccactgccggatttgccgcaaacggcggttttggcattgttgacgcccctgctgccttatgtgttggaaatgctggcgttgcgacggatgccggcggcgtcgttcggcatcttggccagcctggagccggccatcgccgtgctggcgggctggttgctgttggcgcagccggtcgcgccggcgcagctgctgggcgtggctatggtggtcggcgccagcctgggctcgctgctgacggcgcgatgatccggcggcgcttacgccgcgacgccttcgaggcgcagcacctgctccagcgccgaaaaacaggcgggatcgatggcgctgcccaggctgcggcgcatgatgtccagggtttccgctatcggcgtggcggggtggtaggggcgttcggcgttgatggcgtcgaagatgtccgcggtggtgatgacgcgggtttccagcgcgatggcgtcggccttcagcccgcgcggatagccgccaccgtccagccgctcgtgatgggcgcccgccatcaaggccaactccccgaaagagtctatccggctgagaatggcttcggtgtagccggcgtggcgtttcacggcctcccattcctccggcgtcagcttgccgggcttgtccagaatggtgttgctcacgcccagcttgccgacgtcgtgcagcagcgcgccgcgtttcagccagcgccggcgttccggcgccacgcccatccgttcggcgatgcggtcggcgtaatggccgacgcgcaggctgtggccggcggtgaacgggcttttggagtccaccaccaggccgaagccttcggcgatttcatctaggtagtcttcgtccagcggcacttcacattgcgagggctccaacgccagcaccgcctgctcgacgtcgtccgcctccaactggcgccagaaggcttcgtcccggccgatgccggccagcgcccgcgccagttcggggtcgaaccagccgccggcgcggcctgtggcctcgtccagcgccgcggcgcggccatgggtggcgtgcagcacgtcggtcacctgcgacagcagcgcgatgcgcgcgttcaacggaatgccgtctccctgcaggccgcgcggccggccggagccgtcccagtgctcgtccaggcactggatgcccatcgccaccccctcgttgaagcgcaattgccgcgcgatgtcggcgccgcggtgacagcgggtgttgatcagttcgtcggccatttccttgccgcgcagcagcacattgaagatggaggcggcgcgccggcgccagccgtcggcatgggtgccggtctggctgaagacgaagttcagcatttgcggcaggctggcgcccacctgtttgaaagcctgtttgaagcggcggtcgtcggccaggtacagctcgctgatgcgggcggcattgctgctgcagcccaggtctttcagcaggatggtgtagtacagttcccacagcgcttgttcttccaggccgatggcgcggcctatgtgcatgcctatccagcaactgcgcaggcaatgcccttccggctggccttcggtgatgtccagcgcgtagctcagcgcgctgatcagttgcgacagtttcagggtggcggccatgcggtgtcctcgtcgcggggaatgctttgtttatctgcggccggccgcgttttggcaatgcttgttcgcggcgcggctggacgaggcgggctggcggcggtaaaaatgcttacagcatgtgctgtggtttcgccctttcgcaaacttgcctggagcctgccctgatgtctgccgccatcaccctggattttctcaccgatcacgatttcgacaccgtcgcggcgctgggcgccgaaatctggcgcaagcatttcatcatgatgatcacgcgggaacagatcgattacatggtttccagccgctacacgccggaaaagctgagccgctacctggacgcgcccgaccgctggttccgcctgctgcgggtgggtggccgtccatccggctattgcagctacgcgctgagcggccggcccggcgaaatgaagctggagcagctgtatctattggaagagatgcggggaagagggttgggcggcaggatgatggacgaagcggaagccgcggccggcactcagggctgcgccacgctgatgctgactgtcaaccggcacaatgccgacgccatcgccgtgtatgaaaagcgcggtttcactgtgcgggaagaggtggtggccgatatcggtaatggatttgtgatggatgactatgtgatggttaaaaatttataaggggatgtatttatagatttatttcttggatcgaactggcgttccctcgtgttccataatttcagcgaagcgtttccaagtcatacgctttttattgatggaatttcctgaaggtagccacccgatattacccttgctgatcagcagtgtacccagttttgcaccatcaagctttatttcaaattccacatctttgtgtaagatgattttttcctggaggttgagggtgacttcatgggccatggtttatgctccagtgctttgctaagtaattgcgtaaagcggaacgcctcttggtgctgtttatagcaaaaaagcaagcatgtttgcttgctttcccaaagatgatctcctgacgctattgtcactacgttccgcaaaacgtccgatatccctccgcgacctccggcgcggctggcagcgcgtagcgcatcaggccttcgcgttcggtgaacgggtcgcgcagcacttccagcagccgcagtgccggctccatgtcgccgcgttcgctggcggcgtccagcgcttcttccaccagatggttgcgcgggatgtagagcgggttttgcttgcgcatcgccgccgccacgtcgctggcgcggcgggtcttgatggcgaggcgggtcagccactgcagcagccacggctccagttcctgcggggcggggaacagcgcggcgagcggcgcgcgctgtccttcggcggcgtcggccaggtagcgccaggccagcgtgtggtccacgccttgggcggccagcagcgtcagccagtcctcaatcaaagccaggtcgccattttgcgcgtccggcaagcccagcttgcggcgcgcctgttccagccagatggattgatagcggttggcgaagccttcgatgatctcggtcgcggccggcaccgcgccgcccgggtcggccggcgaaatcagcggcagcagggtttcggcgaagcgggccagattccactgcgcgatcgccggctggttgccgtaggcgtagcggccgttgcggtcgatggagctgaacacggtgtccgggtggtgcgcgtccatgaaggcgcaggggccgtagtctatggtttcgccggacagcgccatattgtcggtgttcatcacgccgtggatgaagccggcgtgcatccagcgggcgatcagcgccgcctggcgctcggccgcggcggccagcagcgccaggtagcggtcgtcccggccggccagctccgggtagtggcgggcgatggcgtagtcggccagcttgcgcagcatgtcggtttcgccgcggatggcgaagtactggaaggtgccgacgcgcagatggctggcggcgacgcgggtgagcaccgcgccgggcagcggccgctcgcggtgcacggtttcgccggtggcggccactgccagcgcgcgggtggtgggaatgcccagcgcctgcatcgcctcgccgatgatcagttcgcgcagcatcggcccgacggccgccttgccatcgccgcggcgggaaaacgcggtgcggccgctgcctttgagggcgatgtcgcggcgttggccgttgtggtcgatgacttcgcccagcagcatggcgcggccatcgcccagcgacggcgacaggccgccgaactggtggccggcgtaagcctgggcgatggcttgcgcgccggcgggcagcgccgcgccggagaaggccgcggccagctccgccgcgctggcgtcggcggcgtccagccccagctcggccgccagtggcgcgttccagtacagcagcgccggcgcgggcggcgcgtcgggcagcgcgggctcgtaagcgccgggcaggtcgcgggcgtagctgtggtcgaaggcgatgcggatcatggcggaatccttgtggtgtgctgtcggctggcggcggctgcgcatggcatgacgatatcttaatttcgcgccgccgggctcttgaatttttctttgcgatgccgcgtccgccgtcatggccagggccgggcgcggcaaaaagccgcccatcgggcggcttggtcgggacttagcggctgcggctggttttgccgccaggcttgccgccgccgctcttggcggttgcgggcttgcccgattgcggcctggcgccgacggccggcttgccgcgctgcggggcgttgcccgccgcgcgctgtcccggcgccttgccgcgcgcggccggcgcgcccatgcggtggcgcaccgcggcggccttgtcgcccggcggggtcggcgggatcaggcagtgcttgctgtggccgatcagatcgctgcggcccatctggatcagcgcgtcgtggaggatctgccagttgtccggatggtgatagcgcaggaaggccttgtgcagcttgcggcggtagccgtcgcgcaccacgtccaccttttccgagctgcggctcaggcgcttcagcggattgcggcgggtgtgccacatggtggtggccatcgccatcggcgtcggggtgaaggtttgcacctggtccaggcggaagttgttcttcttcagccacagcgccagattcatcatgtcctcgtcgctggtgcccgggtgggcggcgatgaagtaggggatcaggtactgttccttgccggcctggcggctgaagcgctcgaacagttccttgaacttgtcgtaagcgcccatgcccggcttcatcatcttggacagcgggccgtcctcggtgtgttccggcgcgatcttcagataaccgccgacgtggtgctgcaccagctccttgatgtattcgggcgagcgcacggccaggtcgtagcgcaagccggactggatgttgatcttcttcactcccggcagcgcgcgcgccttgcgatacagctggatcaggtggctgtggtcggtgttgaggttttcgcagatgtccgggaacacgcacgagagctttctacaggacgattcgatctttgggtccttgcagctgaggcggtacatgttcgcggtcgggccgcccaggtcggagatgtggccggtgaagcccggggtcttgtcgcggatctcctcgatctcgtgcaggatcgattcttccgagcggctctggatgatgcggccttcgtgctcggtgatggagcagaaagtacagccgccgaagcagccgcgcatgatgttgaccgagtacttgatcatttcccaggccgggatgtgggcgtcgccgtaggccgggtgcgggttgcgggcgtagggcaggccgtagacgaagtccatttcctcggtggtgagcggaatcggcggcggcgtcagccatacgtcgcgctcgccatgcatctgcaccagcgcgcgggcgttgccggggttggattccagatgcagggtgcggctggcgtgggcgtacagcaccgggtcgtgggcgacggcctcgtaggccgggatgcggatcacggtcttggcgcgttcggcgcggcgcttggccaggcgctcctcgcgcgattcgatgcggatcacctgcggtttggacggatcgatgtccttggtggcctcggctgcctgctccggtatctcttggtacgggttcaggtgcgggtcgacgcggcccggcacgtccaccacgctggagtccatctcctgccattcgtcgtccggccgccagccgtgcggcacgatgaaggcggtgccgcggatgtcgcgcatctcggacagcttctcgcccttggcggcgcggtgggagatttccaccagcgcgcgctcggcgttgccgtacagcaggatgtcggccttggagttgaccagcaccgacgggcgcaccttgtcgctccagtagtcgaagtgggcgatgcggcgcaagctggcctcgatgctgcctatcatcacgccgatgccggggtaagcctcgcggcagcgctgggcgtagacggtgaccgcgcggtccgggcgcttgttgggctcggcgttcggcgtgtaggcgtcgtcggagcgggcgcggcggtcggcggtgtagcggttgatcatcgaatccatattgccggcggtgacgccgaagaacaggttcggtttgcccagttcgcggaacgcgtcggcgctgtgccagtccggctgggcgatgatgccgacgcggaagccttgcgcctccagcaggcggcccaccaacgccatgccgaagctggggtggtcgatgtaacagtcgcccgtgaccaggatgatgtcacaggagtcccaacccagctggtccatttcggcgcgggtcatcggcaggaacggggcggtgccgaaacggctggcccagtacttgcggtaggaatcgattggtttggcggcggcttgcggagtagtcatgcgttcacgtcgaattcaggcagccgcacattatgccgtatccggataaaaaaatcagcataaacaattgtttattatggcgaatcgcccggctggcggtaggggtttgtccgcggcgggccggcgcggggttttgtgatgaaaatcaagggtctgtcgcgcggacggcccgcggcggatgcctggggcatgagtttggtgtacccttgcgggcttgtgcggcgcagcacccggcgggttggcgccgccgcggacattttatcgatcaggatcaaggagggaatatgggcgagcgtatcgtgagcgtggcggcgggggagcgcgatctggtgcggaaactggaggcgggcgccgtgctgcatgtgccagacttcggcttcaccttgagcccggccgaacaggcgctgctcaatccggcgctgtccgatcccaagcgcaagaacatcagcctggagccgaacaacggcgcgctgcacggcgtgctgggcggcgacgagacccaggcggcggtgcgcgcgctgatctcgcgctatcagcaagcggcggccggcctgctggcccgcgtgctgccggaatatcaaggcaagacgcgcgccgcccctaccagcctgcgcctggtgcgggtggaagaccgcaagacctcctggcgcaaggacgacagccgcctgcacgtggatgccttcccgtcgcggcccacctacggcgagcgcatcctgcgtgtgttctgcaacgtcaacccggccggcgagccgcgggtatggcgggttggcgagccgttcgaggacatggcgaagaagatgctgccgcgggtgcccgcgcaatggcccggctcggccgccctgctggcggcgctgaaaatcaccaagcgcaagcgcagcggctacgaccacatcatgctgcatctgcacgacgcgatgaaggctgacctggaataccagcgcagctgcccgcaggaaaccgtgcccttcgcgcccggcggcgcctggatctgcttctccgatcacgcttctcacgcggtgatgtcaggccagttcatgctggagcaaaccttgtggctgccgctggacaagatggacgacccggccaagtcgccgctgcggcaactggagcgcatcgtgggccgggcgctggcgtgagttgggacctggcgggcgatggggctatgactcccatcgcccggcgcgggacttaagcgtctcccactacgacgaaggaggcgacgagactgtatatggcggagtcggaccaggtttcgaaattggcgttgaagccgttattgtcgatgccatttgcgtaaagattgattcgcaggttctcattgtgagaggcgtcgacgtccttgatggacatgatgacttgcggattgcgcagcgagactacggccccgttatggagcttgaacggtacccggatggtgacgggcacgccggacgggagctgctggggatgtttgtagcccgaggaaacctctcctaccaatacgatttgcgtcatgatgatgctccttcgttggaaacggattgaacgcgatccccttgatggtctatccggctgctggtttgggcggcttgcttgtctggcgtaagcctggactggtggctaggccggctcagcgttcttgccgcggctgagccggatgcgcgagccatgcccctttctatatcgtgcgatgcggcaatgaaatcgttggatatacttatcgtatttgcacggatggcggatcgcatgcgcgggccgtcagcgagcagtagcatctagagtggccagcttgcgcccgatattcagtcaaaatcgggtacaatggccgattcgctatccatacccacagccagaacatgagcacggaaaacaacgcgccggttgtcaacaacttcatccgaaccatcatcgaccaggacctcgcgtcgggcaagcacagcagcatcgtcacccgctttccgccggagcccaacggattcgcccatatcggccacgccaaggccatctgcatcaacttcggcctggccgaagactacaagggcaagtgcaatctgcgcatggacgacaccaacccggagaaagagtcgccggagtatgtgcaatcgttcatcgacgatatcagctggatgggcttcaagtgggatggcgacgtgcgcttcgcgtccgactatttcgatcgcctgtacggctacgcggtggagctgatccaggccggcaaggcctatgtggacgacctgtccgccgaggaaatgcgccagtaccgcggcagcctgaccgaaccgggcaagaacagcccctaccgcgaccgcagcgtcgaagagaatctggacctgttcgcccgcatgaagaacggcgagtttccggacggcagcaagacgctgcgtctgaagatagacatggcctccggcaacatcaatctgcgcgatccggccatctaccgcatccgccgcgtgcatcaccaccgcaccggcgacaagtggtgcatctatccgatgtacgactacacccactgcatctccgacgccatcgaaggcatcacccactcgctgtgcacgctggaattcgaagaccaccgcccgctgtacgactgggtgctggacaatatcagcatcggctgccacccgcgccagtatgaatcgtcgcggctggagctgctgtacacgctgacctccaagcgcaagctgctggcattggtcaacgaaggcgtggtgaccggctgggacgacccgcgcatgcccaccatcgccggcatgcgccgccgcggctacagcccggagggcatcaggctgttcgcccagcgcatcggcgtgtccaagggcgagaacatcatcgacatgagcgtgctggaaggcgcggtgcgcgagacgctggaaaacgaatcgccgcgcgtgatggcggtggtgaagccgctgaaggtgacgctgaccaattacgacgccgccgtcaccgccagccgcagcgcgccgttccacccgcaccatccggaattcggcgagcgcgaagtgccgatctcccgcgagatctggatcgagcaggacgacttcgcggaagtgccgccgccgaagtggcagcgcctgaccgccggcggagaagtgcgtctgcgctattcctacgtgatcaagtgcgaggaagtggtgaaagacgccgccggcaacgtggtggagctgaagtgctccatcgaccacgacacgttgggcaagaatccggaaggccgcaaggtcaagggcgtgatccactgggtgtcggccgagcacgcgatccaggccgatgtgcgctggtacgaccgcctgttcaccgagccgcgtccggacgcggtgcgcggtgaagatggcgagtacgtcgacttccgccagttcatcaacccggaatcgctgacgctggtgccggcctatgtcgaagcctcggtgctgcaggccgcgccggaatcgcgtttccagttcgagcgcctgggttacttcgtcaccgaccgcaaggagcaccagccgggcgtcaaggcggtgttcaaccgcaccgtcggcctgaaggacagctggagcaaataagcgacagcagcgatgtcgaatggcgagcccccgggttcgccatttttacgtgcggtccggcgatcggccgcaaggagaagaaaaaatgcgtgtttcgcccggatccatcctgctttccctgctggccgccggcctgttgtccgcttgcgcggcggcgccaggcaaaggcggctacgtcgccggcaagacctacaagatcaccatcctgcacaccaacgaccatcacggccgtttctggcccaatgccgacggcgagtacggcttggccgcgcagaagacggtggtcgaccaagtgcgcgccgaagtgaaggcggagggcggctacacgctgctgctgtccggcggcgacgtcaacaccggcgtgcccgaatccgacctgcaggacgccgaacccgatttccgcgcgatggaccgcatcggctacgacgcgatggcggtgggcaatcacgaattcgacaaaccgctgccggtgctgatgaaacagcgcggctggatacattttccgatgctgtccgccaacatttatcaggatggcaagcggatgttcgatccttacgccatgttcaatctgggcggcgtcaaggtggcggtgctgggcctgaccaccgacgataccgccaagatggtcaatccggcgcagatccggggcatagagttcaagagcccgatcgccgaagccggccaactggtgccggcattgcgcaagcaggccgacatcgtcatcgccgccacccacatgggccactacgccgacggcaaacatggcgtgaatgcgccgggcgacgtggaaatggcgcgcgcggtgaaggggctggacctgatcgtcggcggccacagccagaacccggtgtgcatgaaggccgaaaacgtccgcgacgacgcttacatgccgggcgccccctgcgcgcccgatcgccagaacggcgcctggatcgtgcaggcgcacgagtggggcaaatacgtcggacgcgccgatttcgaattccataacggcaacctcaagctggtgaagtatcggctgatcccggtcaacttgaaaaagacaatggtcgacgcggacggcaaggcgcagaaaacgctgtatgaggcgcgaattccggaagacggcaaattgcgcagtttcctgaagaactaccaggatcgggggcagaccgaattggatgtcaaggtgggcgagctatccgccaggctggagggcgaccgcgccgcggtgcgcagccggcccaccagcctgggcgtgctcgtcggccgggcgatgatggccaagacccacgcagacttcgcggtgctcaactcgggcggcatccgcgactcgctgccggcgggcgcggtcagctatcgggatgtgctcaaggtgtttccgttcggcagcaccgtagcttatgtggacctgccgggcagcgaggcgctgggctatctgcgggccgcggcgaagatgacgcccggcgccggcgccttcgcgcagtttgccggcgtgaagctgcgcatcgtgggcggcgagctgcgggaggcgaaggtggccggagcggccatcgatccggccaggacctaccgcgtggcgatcaacagcttcatggcggcgggcggcgacggctacccgaagatggccgggcatcccggctatgtgaataccggatttgtcgatgccgagatgctgaaggcttatctcgccagccatgcgccggtgcaggctggggcttatgcgccatcgggcgatgtgacgcgcgaatagcgcgggtgggccgcttgtcgttggccgggtgggcaatcatgcgaggtttgcctgcccaggggtactagcccttggtaccggtgtgccggccggagcgatggcttagggtgatgggggcgaaagcatttcgatgcttgaacaatcgcgattccccgccgcattgtgcgttccggcccgcgcgcggccggacggccagcggggttggcatcacctggaggaatcaccatggctcagcaaggcgtattcactcttccggcgcgcatcaatttcggcgccactgtattgaccaatgccgccaatgtgcagaatgtcgccattctggtcgacaacgaagtccgcgccaccttcagcggcagcggcatcaccgacaagaacctgggcactcaggtggtcaactccggcaccggcaacgtccgggtgacggtgactgtcaacggcaaggcttccgacctggtgtccacccaggtgatcctggccaacaaggtgaatctggccttgctgggttcggaagacggcaccgatgccgactacaacgacgccatcgtcctgttgaactggccgctgggctaagctgcccgcgcgctgggcccgcgcttgccgcaggcttggcgcgcccccgtttggcgccaagtcgccgctcgcgttgttttcgcaggcggcgatttgccgtgtctactgtaattcccccgcaacttcgcaagcggtttgccgccggtcaaggaatcccgttttgccgcggatgcgcggcttgaggcggctttcccgcaagtggtatgttggtggtgtcagcggcgccgctatgcctgcgccgccttgtccgtccactcattccaggttgcgatcatgtccaagctccgagccgtatatctgcaatccggcggccccaccgccgtgttgaacgcttccgcccagggggcgatagagacggcgcgccgcctcggtctgtcgctctatgccgctttcgacggcctggcgggcctgctggacggccggttgtgcgatacggacggcgtgcccgataccgccatcgcccagctggccttcatgcctggcggcagcttcggcgtcagccgccgcatgataggcacattcgaagaggcgccggaagattggctgcggctgcgcgatgtcttggccaggcatgatatccattacctgctgatcaacggcggcaacggctcgctcggctgcgccgagcgtctggtcgatttcgaaaagcacaccggctacaagctgggcgtgatcggcgtgcccaaaaccatagataacgacctgatgggcaccgacaacagtccgggttacggctcatcggccaaattcctggccagcgcgatgcgcgaggtggggctggacatgaccagcatgggctgggggcgggtgttcatcatggaaaccatgggccgccacaccggctggctggcggccgcttgcgccgctgccgcgcgcgcgccgaacgaggcgccgcacttgctgctgctgcccgaggtgccgttcgagccggcgcggtttcttgcggcgctggacgccagcctggccaagtacgggcaatgcgcgatcgcggtggccgaaggcatcaccggtcaggacggccgcttcgtcgccgaagccaagcagtcggaaacctacggccatgagcagttgggcggcgccggccattggctggcgcagctgatcctgcgcgagcgcggcatttccgcccatgtcgcccaggtcgactacctgcagcgcgccggcggccacctggcttcgaataccgacgtgcgccaggcttatctgatgggcgagcgggcggtggagtggctgctggccggcaaaaccgggttgatggccggcattcggcgcttgaacgaccacccctattgctgggacgtggccgaggtgccgctgtccgaggtcggggacaaggaaaagcgcctgccgccggcgttcatcggcgccgacggtttcagcgtgaccccggcttttctggactatgtgaaaccgttgatggagggcgagcgcattccgcctttcaaggacggcttgccggattaccggccgatagcctggccaaaagtttgactatccatatatttccatgtcataaaccgtcggcgtgccggcggttttgcattattcaagcgcctgtaacagagtcaggccgcgctctgctacaatcgtccctttcgatagtccaaccataggttttttgatcatgctgagcttgtacaacacactgacccgccagaaggaagcgttcaaacccatcgaacccggcaaagtgagcatgtacgtctgcggcatgaccgtttacgacctctgtcacatcggccacgcgcgtatgctggccgccttcgacgtgatctaccgctggctgaaggcctccggctatgaagtcgactacgtgcgcaacatcaccgacatcgaagacaagatcatcaagcgcgcgctggagcgcggcatcacgccggagcagctggtggaggagaccatcgccgacatgcaccaggacgccgccgcgctgggcctgctgccgccgacgcacgagccgcgcgccacccaccacgtgggcggcatgatagcgctgatcgaacagctgatcgccaacggcaaggcctatccggccgccaacggcgatgtctactacgcggtgcgcgaattcgaaggctacggcaagttgtcgggccgcacgctggacaagctgcgcgccggcgagcgggtggaagtggacccgaacaagcgcgatccgctggatttcgtgctgtggaaggccgccaagccgggcgagccgtcctgggacagcccgtggggcaagggccgtccgggctggcatatcgagtgctcggtgatgagctgccaccatctgggcgagcatttcgacatccacggcggcggcgaggacctgcagttcccgcaccatgagaacgaaatcgcccagtccgagggcgcgcacggccatcagtatgtcaactactggctgcacaacggcttcatcaatgtcgacggcgagaaaatgtccaagagcctgggcaacttcttcaccatccgcgatgtgctgcagcatttcgatggcgaagtgattcgtttcttcatcgtgcgcagccactaccgcagcccggtcaactacaccgatggcatcctcaacgacgccaagcacggcctgacccgcctgtacacggcgctgcgcggcatcgaactgccggccgccagcggcatagactggaacaatgcctacgccgcgcgcttcaagaaggcgatggacgacgatttcaattcatccgaggcggtggcggtgctgttcgagctggccggcgaggtgaacaagagccacgatccgcaacaagcgcgcttgttgaaggatctggccggcgtgctgggcttgctcggccgcgacccggaagccttcctgaaaggcggagtgggcgagggcgagctgtcggccgaacaggtggaagcgctgatccaggcgcgcaaagatgcgcgcgccgccaagaactgggccgagtccgaccgcatccgcgacgagttgaccgccaagggcatcgtgctggaagacggcgcggccggcaccagctggcgccgcgcctgagcgatctgccgtttgcgcgcttgtcaagtggcggcaaacggcggataatgccacgtttcgcaagcagtgcaggcaaaacccctgcacccgttatgaaaggtagagagatgaaaaccgatattcacccgaattacaaagaactgtccgttacctgctcctgcggcagccagttcgtgaccaagtccaccatggccaaagacagcttcggcatcgaagtgtgctccaactgccacccgttctacaccggcaagcagaagatcgtcgacaccgccggccgcgtggacaagttcaaccagaaattcggcggcttcttcaagcgctaagcctggccgtttctggaagacaaaaaaggcagccctgcggctgccttttttcatgccgccaaggcatgggataattgatttgacccttcagaacgctaaggtggcaatcggatgctgacttattccgcgcaggccagttcgctggccaagccaaccgagaaaccctgggtgctgctgctgctgtgcttcatctggctatggccgggcatcctggggcatgacccctggaaaccggacgagcctttcgtgctggcggcggcgcaaggcatgctgcataccggcaactggctgttgccgaccctgcagggcgcgccgtatctggacaaccctccgctctattactggctggctgccggcttgatccggctgttctcgccctggctgctgccggcgcatgacgccgccaggctggccacgccgctgctgatgtcgctgtcgctgctgttggccggcatggccggccgcgagctgatcggcaggcgtcatggccgcagcgtggtgatgatcttgataggctgcatcggcctggtggagtccggccaccagctgacgccgatgatagcgggctttgccggcttcgccgccgccttctacgcgctggcgctggcgctgcgctcgcctggcctggccggcgccatgctggcggcttccagcgtggcgattttcctgggcggaagtctggccgatctgctgctgatctggctggcggcgttgctgctgccggcgttcagcggctggcgcaaccggcagtacgcgatcactctgctgctggcgctgttgctggcggtgccggccatcctggtatggccgatgctgctgctgcgcgattcgcccgcgctgttcgccgactggtggggcaattacgcgctggggcagaccagcggctttcatcgtctgcggctgtttcatgatttcggctattacagcctgaacgcgctgtggttcgccttcccggcctggccgctggccttgtggacgctgcaccgcaatcgctatctgcagtcgcccaagttgcagctgccattgttgttttcagtggtgatcgcgctgggcctgaccctgtccgaccgggccaacatcaccgacgcgatgccgctgctgctgccgctagccgtgctggccgcggtggagctggacagtttgcggcgcggcgcggcggctttcctcaactggttcgcgttgatgacttgcggcctgttcggcctgctggtgtggctgggatgggcggcgatgaactacggctggcccgagcgcctggccggacgcgcgcagtatttcagcccgttctaccagccgcatgtgtcgtggtggcaggccggcggcgcgctggcggccacgctggcgtggctgtgggcgttgacgcggccgcacttgcgcgggcgccaggccatcaccaactgggcggcggggctgaccttgctgtggggcctgggcatgactttatggctgccctggttcgatgccgccaagagctatcgtccggtggtggccgccatggaggccaagctgcccgccgacgcgcgctgcgtcgccaccgaaagccgcaaccgcctggcgcagatcagctggcgctattacgcggggatggatctggtatcgttcccggccggcgagacgcctccctgcgattattggctgatcgtgcgggacaagagcgaaggcatggcggaacccggctggcaagtgctgtgggtgggccaccgtccgcgcgaacagaacatgactttcgcgctgctcaggcgcctgccgacggcgcagtaggactgcaacaagctggcgaagccattccggctggcgccgggatggcttttgttttgggatggccgaagtttcgcgcggattgccccggcttggcccgggcaatggctttttcttgcggcggccgctttggcgcggcctcggccggagcggcttttcccgatcgggatgttcctgcgcgcggcgtcatggatgcgcgagcagcgggatccgcgagatcctcttgtttaccataccctgccagactgtcttgtcatccaccgcgtagcgccagcattgggcgccggggtcggccaggcaaatcgacagggcctttttcatcgcatcggcatcatggctgatccggcgccagccgccgcgctggtgggtcgccaatgccttgggactggccgcctgcaaatacgagctatcccggccggctcattccatttgcaggccggcgagaatatgggcttgctgggtttcggaaatcggcagcaccgagaccagcttttccttggcgacgccgggaatatattgggagatattgccgatgtcggacggcagggccggattgtcggggttctgcatcagatgccgggcgcagtcgatggcgatttgggcgatatgcgtgcgcggcctgtcgacgccgcggatcaactggctgatcatctgcggcaattgccagatgtcggccagggccagcgtcaattgccgaaacgtgaatccggcggtattcaattgcgccaggccagttcggttggcgcgtccggcttcgaattccgcgatggcctgggccggcaactccggcgcgaaatgccataacagcaattcgcccgtttcggaaagcagcgtggccagggagatttcttcgggggaggtgtcggagcggaaattcgaccaggcccgcgcgatgccggacgccaggactgcggtggccacggcggctttccagcccgggtggttcaccgccacgaccgggcttctggagatcagcgaatacaactcatcgctgccgagctggagtatggcgcccaactgggtggtagtttccttgccgaggcgtctggagcgatgccgttcggcttctatcagcaatttgagggcgagataggggtcgtcgtgcaccatgtccaccagttcccgcggcgaaaactcaggcgcgtcgtttccctgggatttcagcgcctggaaactatctctcgtcgccgataaaacgggtatgtccttgtctttcagataggctgcccattgttcaataccccagctttgctggtgccggctcaacatgtttccgctccgaaaatcgctgcgcttcgcttgctggcgcgatgggcggattccgcttgcgtccacgcaatccgccgctgctcaaaagcgcttgtattcatgataattcagttcagcgcatcccgtgtttgaaagcatgccgatagcgccctgatttggcgcatttggcggattttggaatgaaatggtcgcgtcggcgcggtttggccgggcgcttggctatcgagcggccaaaaaaacgagggctgccgccctcgtccttttcatggcatgccgccgatgtttattcggccagctcgcccaggttttcgaacagcttcagcgcttccggattggccagcgcgctgacattgctgaccggccggccgtggatgacgtttttcaccgccaattcgacgatcttgccgctgacggttttggggatgtccgccaccgccacgatgcgcgccggcacgtggcgcgggctggcgccgttcttgatctgggccttgatccgggcggtcaggtcttcgtccagcgccgcgccgtcgcgcagcttgacgaacagcaccacccgctcgtcgtcctgccaactctggccgacggccaggctttccaggatttccgggaaaacctccacctggcggtagatttcggcggtgccgatgcgcacgccgccgggattcaataccgcgtcggagcggccgtagatgacgacgccgttgtgggcggtcagctcggcgtagtcgccgtggcaccagatgccggcgaagcggccgaagtaggcctggcggtatttttcgccgctgtcgtcgttccagaagcctatcggcatggaggggaaggggcgggtgcagaccagctcgcccttctcctggctgaccggccggccctgttcgtcgtagatgtccaccgccatgcccaggccgcggcattgcagctcgccgcggtacaccggcagcgtcggcgcgcccagcgcgaagcaggagacgatgtcggtgccgccggagatcgaggccaggttgaggtcggccttgatgttttcgtacacccagtcgtagctttccgccaccagaggcgagccggtggagaacaaggcgcgcagattggggagctgccagtcgcgcgccggcacgatgtcggttttgcgcaggctgtctatgtatttggccgaggtgccgaaatgggtgaagccgtgttcggcggcgtagtcccacagcacgcggccgtcgtcggcgaacggcgagccgtcgaacagcatcagcgtggcgccggacgccaggccgctgaccagccagttccacatcatccagccgcaggtggtgaagtagaagaagtggtcgccgcggtgcaggtcggcgtgcagctgctgctccttcagatgctgaagcagggtgccgccggcgccgtggacgatgcacttgggcttgccggtggtgccgctggagtaaaggatgtacagcgggtggttgaacggcaggcggacgaactccacggcccgcgccgggtggggggcgaggaaggcgtccagcgtttcggccctgggcacggcggcggcgaaggttttgccgtcgccaaggtagggaaccaccacgatgcggcgcacgctgggcaggtgttcggccaggtggatcattttggcgcggatgtccacctgcttgccgttgtaccagtagccgtccgggcagaacaggattttgggctcggtctggccgaagcggtccagcgcgccgtcggtgccgaagtcgggcgagccgctggtccagaccgcgcctatgctggaggcggccagcatcgccgccagggtttccggcatattgggcatgaaaccggccacgcggtcgccagccgtgatgccggcggcgcgcatcgcctgctgcagccgggagaccagctggttcagctcatgccagcttagctggcgctccaccttgtcttcgccgcggaacaccacggccagcgcgtcgtcgtcgcggcgcagcaggttttccgcgtagttgagccgcgcttcggggaagaagcgcgcggtcagcatatcgtcttcgcccgccagcgccacgccgcccttgtcgccgatcacgccgcagtagtcccataccagcgaccagaagcggccggggtcgtccacgctggcctgccacaggctgtggtagtcgggcaagggcttgttccaggcggtttgcgccagcctggcgaaggcggtgagatggcatccggccagccggccggcggagggcgtccagatggggtgatggcttgcttgcatggtttctcctgtggcgcggcccgtggttgttgatcttgcttgtgcgggcgcgccggtttgtatcaggcctggcgtccgagcgcgtgcgcgagcttggacgcgggcggcttgcccagcgcatcgctgacgtgccaggcggcggccaccagtttagtcagatcgatgccagtgtggtagccctcgccgcgcagcagataggcgacgtcctcgctggcgacgttgccggaggcgcccttggcgtacgggcagccgcccaggccggcgaccgaggcgtcgaacacccggatgccagcgttgagggcttcgcggatattggcgatggccatgccgtaggtgtcgtggaaatgcccggccagccgcgcggccggcgcggttttcagcacggcgtccagcatctggtgcaccgaggccggggtgcccacgcctatggtgtcgcccagcgacacttcgtagcaacccatgtccagcagggtttgcgtcacttcggccaccttggccggcgcgatcgggccttcgtaggggcagcccaccacgcaggacacgtagccgcgcacgcggagcttctccgcctgggcgcgccgcatcaccgattcgaagcgctgcaggctttcggcgatgctggcgttgatgtttttccggctgaagctctcgctggcggcgccgaataccgcgatctcgcgcgcgccggcctccagcgcggcgtccagtccctggtcgttgggcaccagcaccggataggcgacggcgccgccaaggtccagagccttgagcacttcggcgctgtccgccatttgcggcacccacttgggcgagacgaaggcgccggcctcgatggcggagaggccggcgtcggccagccggcggatcagttccagcttgacggccagcggcaccagctgtttttcgttctgcagcccgtcgcgcgggccgacttccacaatcttcacgtgttgcatggttttccttggcgcagcttgggctgaatcgggaggtagatgtccatctggaggcgggtctggcctggcgcgcagcgtccgtcgtagcgctcaaagacatcgccgggcgcatgctgccagtcggcggaagcaggcaaccagtcctggtagatgcgttgccaggtctgagcgatgcgctggccgaactcggcggggccggcggccggcggggtggtgaaaacggcgtatctggcagggggcagacgccgtcgttcgacgccgggaggcagggcggccgcgtccgggcattcgatggcgatcagatagcggaagccgccgccggcggggtcgaaatcgtagaccacgccgtactccgcggcatggggcaggcgcagcgcatccagcagcggctggcgcaggcgggcggcgtagtccgcccagaaagcggggatgtcgcgcagattgtcgccgtccgccttgcgggtggcgatgctgtggcccgccagcgccaagccggggcagtcgatgatggcagcttccatgccggcttccttgttgggtttcgttaccaggcgcggtccaggtcttcggcgtagaagcgcagcgtttgccgatggttctggatgccggcgtcgccgctggtgccggccagcagctgcagcaggctttgcgtggcttccttgtgctggccgcggttgtacaaggccatcgccaggaaagcctgtaaggccgagttgtccgggaaatgctgcaggccgtggcgcaaggcggcttccgcgtcggcgtactgccccagcgcccgcaggctgctgcccaggcccagccaggcgtgggcggcgttgtcgccgctcaggcctagctccagcgcttgctggtaatgcggaatggccgcggcctccagccccatgccatcgtggatgcaggcggtcagataatgcagatcggcgtgctgtggctggtgctgcagcaattccagcgcctgtttgcgagcggcgtcgtgctcgccgcgagcgcgcaattgctgaattttctccagagcgatatgcatggtgtcgattcctttttatgcattaatgactaagtcattctgcggcaaaatccaccagttcgtcaccatcattgacctgctcgccggcggcgaagtaaaaatcctgcaccacgccatcgccgggggcggtgatggtgtgctccatcttcatcgcctccaggatcaacaacggcgagcctttggccacctttttgccgatctcggccagcagcgccaccacccggcccggcatcggcgccttgaggtgggtttcgccgtgcacgcccagttcggcgtaggcatagggatccacccaatccagcgccaggcgttcgccgtttgcgaacagcacccgctgcgcgccgtggcgcgccacggtggcgtggatggcggcgccgtccagcgtggcgcgcagttgctggccttgcaggctggcgcgggcggcgaatgtttgcccgttcgcggcgacggcgtaagcattggctgcatggcgcagcgtcgccgcatgctcttcttcatcctggcggaagctgaagcggcgcgtctgctcgccattcagccgccagcctgcaggcgccgggtaggtcggttggtccgccagcgcttcggccagcgccagcagcgccaactggcgggccgtcggcgcggcgggcggcggcagcagttcgtcatggtggcgggcgatcaggccggtatcgacatggccgccggcaaagctggggtggttgacgatgcggcgcaggaaagacacattgctggacaggccgacgatctggtactgcgccagcgcggcgtccatctgccggagcgcggcctcgcgggtttcgccccagacgatcagcttggcgatcatcgggtcgtagaacggcgagatggcgtcgccttgctcgacgccggtgtcgatgcgcacattggcggactccgcaggcgtggccagatggaccagcgtgccagtggacggcagaaagcccttgtccgggtcctcggcgtagatgcgggcctcgatggcgtggccgcggatggccagctgctcttgcttcagcggcagcgcgccgccggcggcgacggccagctgccaggccaccaggtcctggccggtgatcatctcggtcaccgggtgttccacttgcagccgggtgttcatctccatgaagtagaacttgccggtgtcgacatccatgatgaactcgactgtgccggcgccgacatagcccaccgcgcgcgcggcggccaccgcggcttcgcccatcgcctcgcgggtggcttgcggcaggtggggggccggggcttcttccagcactttctggtggcggcgctgcaccgagcagtcgcgctcgaacaggtagacgcagccgcccagtgtgtcggcgaagacttgaatctcaacgtggcgcgggcgggtcaggtatttctccaccagcaccttgtcgtcgccgaagctggcgcgcgcttcgcgctggcaggaggcgagggaggcggaaaagtctgcgctcttttccacgatgcgcatgcccttgccgccgccgccgctgctggccttgatcagcaccgggtagccgatggcgtcggcctggttttgcagcagcgccgggtcctggtcatcgccgtgatagccgggcaccagcggcacgccggctttctccatcagcgccttggcggcggacttgctgcccatcgcggcgatggccgaggccggcgggccgatgaaggcgatgccggcggcctcgcaggcggcggcgaagtcttcgttttccgacaggaagccgtagccggggtgcaccgcctgggcgccgctctgccgggcgatggccaggatccggtcggcgcgcagataggactcggcggccggcgccgggcccagacggtaagcctcgtcggccagcttgacgaagcgggcgttcgcatcggcgtccgagtaaacggcgacggtggcgatgcccagggccttggcggtcttgatgacgcggcaggcgatttcgccgcggttggcgatcagtatcttattgaacatggcggtctcccgcggcgaaaccgccctggcgctggggcgccggcaggcgatgttgcttcgcagctgcgcagccttgcggctgctggtcgcctctgtttgcgatcagtatcttgttgaacatggctttgtcctggttattcctgccacttcggcgcgcgtttctcgaagaacgacgccagcccctcgcgcgcctcgtcgccggcgcggatggaggcgatgcggccggcggtgtgctccagcaattggtcgtcccacggcgagccttcccgcagctcggccagcaacagcttggcttcgcgcagcgcgcccggcgcgcccttggctagctcttcggcgatttcggccacccgctggtccagcagttcttcgctgaccagctcgtggatcagccccagcttcagcgcggtgccggcggggatgcgctcggcggagaggaaatagcgccgcgcctggcgcgggccgatggcgtcggcgacataggggccgatggtcgcggggatcaggcccagccgcacttcggtcagcgcgaacttggcggcgtcggtggcgatggcgatgtcgcaaaccgccgccaggccggtgccgccagccatcgccgcgccgtggatgcgggcgatcaccggcttggcgctgcggtagacggccttcagcatggcggccagcttttgcgcgtcggccaggttttcggcttcgctgtagccggcggcgcgccgcatccagtccaggtctgcgccggcgcagaagctcttgccgcggccggccagcacgatcacgcggacgtcttgcttgcggttcagctggcgcatcgcctcggtcagctcggcgatcagcacttcgttcagcgcgttgtgcagctccggccggttcagccagacggtggctaccttgccggcttgctcgatttgcagcgtggtgtggctcatcatccgctccttacatccggaacacgccgaagcgcgtggcttcgaccggggccgacaacgcggcatccagcgccagcgccagcacgtcgcgggtctgggccgggtcgatcacgccgtcgtcccacaagcgggcgctggcgtaataggggtggccttgttcttcgtactgctggcgcaccggggctttcagcgcctcttcctgttcagccgtgaaggcgtcgcccagttgttccttcttcacctgcgccagcacgccggcggcctgttcgccgcccatcaccgagatgcggctgttcggccacatccacaaaaagcgcggcgagtaggcgcggccgcacatgccgtagttgccggcgccgaagctgccgcctatcagcacagtgaacttgggcaccttggcgcaggccaccgcggtcaccagcttggcgccgtccttggcgatgccgccgttctcgtacttcttgcccaccatgaagccggtgatgttctgcaggaagatcagcggaatgccgcgctggcagcacagctcgacgaagtgcgcgcccttcagcgccgattcgctgaacaggatgccgttgttggcgaggatgccgacgcgatagccgttcaaacgggcaaagcccgtgattaatgtggtcccgtagttctgcttgaattcgtcgaagtccgaatcgtccaccagccgggcgatgatctcgcgcacatcgaacggctttttcagatcggccgggatcacgccgtagatttcctcggcggcgtagcgcggcggtttgggctcggcgcggtcgagttcgccttgtttcttccagttcaggtccgacacgatgcggcgggcgatggccagcgcatgggcgtcgctttgcgccaggtggtcggccacgccggagattttggcgtgcacgtcgccgccgcccaattcctcggcgctgaccacctcgccggtggcggcgcgcaccaagggcgggccgcccaggaagatggtgccctgttccttgacgatgacggtttcgtcgctcatcgccggcacataggcgccgccggcggtgcagctgcccatcaccacggcgatctgcggaatgccggcggcggacagattggcctggttgtagaagatgcggccgaagtggtcgcggtccggaaatacctcgtcctgcagcggcaggaaggcgccgccggaatccaccaggtagacgcagggcaagcgattgtcgcgggcgatttcctgcgcgcgcagatgcttcttcaccgtcatcgggtaataggtgccgcccttgaccgtggcgtcgttggcgatgatcaggcagtcgatgccggaaatgcggccgatgccggcgatcacgcccgcgccgggcgcgtcgccgccatacatgttgtaggcggctagctgggacagctccaggaacggcgcgccggggtccagcagcaggtcgatgcgctcgcgcggcagcagtttgccgcgcgcggtgtgcttggcgcgggctttttcgccgccgccccacgccgcctgggcgactttttgtttcagatcgtccaccagcgcgcgcatcttgtcggtgttggcgacaaagtccgcggcgcgcggcgacagcttggattcgaggatgggcatgtggtttaccttgtcattcggcgtcgacgaaccagacggctgctatcaatccatcggcgttgatatcgtagatggcgacggcgcgaaagcggttttcgccgtccagcgtcacctcctcgtggtcgatgacgcggctgccctgcacgatgcggtgcagcagcgcggcgtgcagcttgggcaggttgaagcgcttgccggcgtagtggtcggccagcgcggcgcggccggataggctcagcgccatggacggcaggcggtagaccttgacgtcttcggcgtagcaggcggcgaaggcctcgagattgcgggcgttgtaggcgtccagctgggcctggacgatgcgttcggcggcgttcatgttttggttttcctcggtatggccggggcatggttggaaaaatcgtccgagacaaggcgcgccgccgcagacagtacaaatagtacggccaggcggcgcaacgccgtatcggacgatttagccaccatgcttatcgggtttcggccatcagttcgcggccgatcagccagcggcggatctcgctggtgccggcgccgatctcgtacagcttggcgtcgcgcagcaggcggccagtggcgtattcgttgatgtagccgttgccgcccaggcactggatggcgtccagcgccagctgggtggcgttctcggccgcgtacaggatggcgccggcggcgtccttgcgggtctggcggccggtttcgccgcggtccagcgcctggcccacggcatagacgtaggcgcggctggcggacagcttgacgtacatgtccgccagcttgccctgcatcagctggaagtcgccgatgggctggccgaactggctgcggtcgttcagatagggcaccacgatgtccaggctggcctgcatgatgcccagcgggccggcggccagcaccgagcgctcgtaatccaggccgctcatcagcactttcacgccattgccttcgccgcccagcacgttttcttccggcacgaaacagttgtcgaagaagatcgggtaggtgttggagccgcgcatgcccagcttgtccagcttgctgccgtggctgaagccggcgaaggacttttcaatgatgaaggcggtgatgcccttgggaccggcgttgacgtcggttttggcgtatacaaccagcgtgtcggcgtcgccgccgttggtgatccacatcttgctgccgttcagcaggtagccgccgtcagtcttgtcggccttcagcttcatgctgaccacgtcggagccggcgttcggttcggacatcgccagcgcgccgacgtgctcgccggagaccagcttgggcaggtatttcgcgcgctgtgcgtcgttgccgttcttgtagatctggttgacgcacagattggagtgcgcgccgtaagacaggcccaccgaggcgctggcgcggctgatttcctccatcgcgatcatgtgggcgaggtagcccatgtccacgccgccgtactgctcgccgacggtgatgccgagcaagcccagctcgccgaacttgcgccacagatcggccgggaacaagttgtcctggtcgatggcggcggcgcgcggggcgatttcgcgatcggcgaagtcgcgcaccgattcgcgcaggaggtcgtaagtctcgccgaaggcgaagcgcaggctgctgtacatggaattctcctcgttgggcgtgcggcgcggctggcggcgcctgatgagcacatcatcgcttacgtttacgtaagcgtcaatatgtcgccatgatgaggagccgactgggcacggcgggcgcttattcgcgattgatcacatggcgcaggctgcggtcttcgctgatcagcatgtctttcatgggctgcggcaggatgcgcagctcgccgagctgctcgcggctgaaccagtcgaactccaggcgagcgccgccgtcttcgattgcgaacggcgtggcgcggctaggcagcgcggagcccgcggccagatgagtctggaaatacaagcccagctcatggttgcgctggccgcccgcgctgaagaagttttcaatcagcatgaccatctcgccgcaacgcacggcttcgcccagctcctccagcatttctcgttccaccgttttggccgcttcctcgtcggggtctacacggccgccgggcagggtccagaaatcgtcgcggatcaggcggtgcagcaagaccttgccctcatgctcgatgatggcggcggcgcgcagattgaaacgggtgccggctatgtcgacgctgatcacttgctatctccttggcatttttggcgggcgcgcagcatagcgctttctcccgtcatggacaagggcaggtatcatggcggcctgttgatagagaaagaagccgacatgacgatctgggtagacgccgatgcctgtcccaaggtgatacgggaagtgttgttccgcgcggcgcagcgcaccggcgtggagttggtgttggtcgccaaccagctgctgacggtgccaaaggcgccgaacatccgcgcgctgcaagtgcccaagggcttcgatgtggcggacaatgagatcgcccgccgcatcgagccgaccgatttgctgatcaccggcgacattccgctggcgtccgaggttctggccaagggcgcgcaggcgctgaactggcgcggcgaggcgttttccaaggaaaccatcgccgcgcaactgacgatgcgcgatttcatggacaatctgcgcgccagcggcgtgcagaccgagggaccgccgcctttgagccaggccgaccggcaggccttcgcacgccagctggacatctggctggcgaagcggcgctaggggggaagcccggcttgagccgggcattatgccaagtagtggccgcagaggggatgatttgtggtgcagcttccgccagtaggcgggtcagggggctgcgcggccagccccccgacacccccaggccgccccgacagcgcgtcgaaaccccgtcttcaaagccatttccaaggagccgccggaactacatgcgtgcgaatctctgattcgctcagcagtacgcgctaccgtcgcgcggcgtcgaacaaccggcgtcttaaaacctcggaaatggcttcgaagccggctagcgctgacggggatgacgcacatcggttcggtttcacagcatttgtataagttgtcgccaaattgattgatcgtcaaagcggtatccgccatttatgcaaaagcccccgaatccgggggctttgtcttgtctgggaggcgagagactcaggccttgcccagatgcggttcggcgtcgaattcttccttgtcggcttgggccgcgcccggctggcggatggtcagcgagaacagcagggcgacgatcagcagcgccagaatcaggtggaaggtggcgaggaagccgccgaacagcgaggccacgatggagccgacgatgctgccgataccgaagcccaggtagatcacgccgtagttcttggtcaggttgttcaggccgaagaaatcgctgaccagcgaagggtagacggtgatggtgccgccgaagctgaatgcgatgcaggcgatagcggcgaagaacaggccggcgttgagcggggcgaacagcagggtcagcatgccggccagcgcggccacttgggcgatggtgatgacgcggatgcgcggcatcttgtcggacagcacccccagcaccaggcggccggacaggttggccacggcgatcacggcgacggcgttggcggcggtggtggccgacaggtggacgaagctctcgccgatgtccttggccacaccgatcacgtacaggccgctcatgcacacggtcaggaacatcagcgccagcatccagtactgcggctggcgcatcgcctcggccagcgtgaagtcgcggctgccgccggtttgcgcggcggccggctgttgcggcgcgtcagtcatcagcagggcgcctgccaccaccatggccatggcgatcaggccccacagctggaaagtggcttccaggctgaaatgcgacagcagcgccaggttgatgaacttgaagcccaggctgcccaggccgtaagcgccgatggcgcaggccgagatcaggcccttgcgctccgggaaccatttcacgcaattggacagcgacatcaggtagccggcgccgtcggcgaagcccaccagcaaaccggcgcacaggtagagcatgatcaggctgccggcatgcgaggtcaggtaaaagcccaggcccagcagcaggccggaggcgatggccaccttgcgcacgccgaagcgctcctgcaatttgccggccatcgacgacgccaccgccagcgcgaggctgagcaggccgaaggcgaaagccacctggctgaccggctcgcccagcttgtgcgacagctgggcgttgaacaggctccaggtatagacggaacccagcgcgaactgggtgaggacggtaccggccagggtacggtagcggatggcgttgcttgaggcgttcatggcgctgctcgcttataaagtcattactgttggcatgactataagcccgcgcttataaaggcggcgcagcgtgggaatgaaatgcagacgatggggaatgaaatgcaatcgggggggcatcagtcacaatgcggctgaatgggcgacgctactgaagcggtaaaatcttgatacggagggaggatggactttcagttcgagtttgactgcaacggggtggatggcagtcgaccgttgctttatttatgggatgtgggcggccgtctttacattgggaaggcgagccgaggaagtaaacgtccgttgaagcattacgcgcgaaacgtgagccgcttgttggccggccagccgtaccgtcgaggcaagccgaatggttttaggaaagtgcatctagccatgcaggctgccgtattgcagtcgcaacggatcaggctggtgctattgaaaaacgtcgagcttgcacgaattaatgaagaagaactgacggcaattaaacagtatggttgtgagttgaatgagcaatggccgcggggttgtttgttgactcaatggcctagcgctagagatgcatcagctgcctgaacgccttgatattgctgcggctgaccgggatttccgccttcaggtcgtacagtttgatgatgtaggtgctgttctgccacggcgcgatttcgcggatcttgtggatgttgacgcagaaagagcggtggcagcggaagaagctgtcggccggcagccgcgacacgaattcgctgatgctcatcgccatcacgtagcggtcgcgggcggtgtagactagggtgactttctcgtcggcctccacgtagtagatgtcgtcgcagggggtgacgatgatgctgtcgcccttggccaggttgacggtgcggctggccggcgcggcgtcggcggccggggcgcttgccgcggcggcgggcggcggcgccggctccagcgcttccagcttgtgcagcacgtgggcgatgcgctgttcgttgtagggcttgaggatgtagtcgaaggcctccacttcgaacgcttccaccgcgaattccttgtaggcggtgacgaaaacgatgcgcggcggacgggtggtcttgtgcaggttcttggccaagagcaagccgtctatcgacgggatgtggatgtcgagaaacaccacgtccacctcgttttcctgcagaaacttgaatgcctccaggccgtcctcgacgctggccaggatctcgatgccgctatgctcgcggatcaggtaggccagctcctggcgcgccaggtattcgtcttccacaatcagcgccttcagcatgccgcctcctccgccggcaggtcgaagcataccgcggtgccgggctccagccgcgtcagccgcaggccctcgccgtacaaaagcttcacccgctcgttgacgttcatcagcccgatgctgcggctctccaccttgccgtcggcgatgccgtctatcacttcctggctgatgccgtagccgctgtctcgcacgcagacatggatgcgcgcgccgtcgcgcttcaccgcgatgcacacctcgcccggccccttgcgcggctggatgccgtgcaggatggcgttttccaccaagggctgcagcaacaggctgggcacccgcacatgcacgtcgtcgacgtcgaacaccactttcaacttgtcgccgaagcgcgcctgctcgatggcgacgtagtcgcgcacctgcttcagctcttcctggatgtcgatcagcgtgtcgcccagcgacaggttgtagcgcaggtagtcggccagcttggcgatcagctggcgcgcttccgacggctggatgcggatcagcgacgagatggcgttcagcgcgttgaacaggaagtgcgggttgatcttgctttgcagcgcggcgaattcggccttgcgcgccatttcctgcagctgcttgatccgcgacgcctccatctgggtggagatcagctgcgacaggccgacggccagctcgcgcagcgaactggtgatgccgccgctcttgcgatagaagattttcagcgtgccggtgacgcgggcgttttcgcgcagcgggatgatgatgaccgagtggaagtcggccacccggtagcgctgcagattgttctcgatgatgatctggtcctgttgcaccgcctggcgggtgatttcgccgatggcggagtgggcggccggttcgtagtagtccttgcccaggccgacataagcctgcacgtcggcggtgtcggtgatggccaccgcgtcggcgccgatgtggttgcggatcaccgtgcacacctccaccagcgcgtcgcggtccacgttctggaaatagggcagggtctggttggcgatggtcagcgccagcttggcctggcgcgccgccagcagctccttttcgtcatccaggtcttgcaccagcttgatgaccaggccgatgcagacggtgccggtgatcatcgggtaggcgatatggccgacgatggcgcggccgatggccggctcggtgaaccacaggatcagcgccatggtcaggctctcgcaggctatgccggcggccacgccgtacagccacagccggcggcggccggcgcggaaatggatgatggtggcgagcaagccggcgcagatgctggagatcaggcagggcagcgaggtatagccgtggatgtctatcaaataacggtgcaggccggagacgatgcctgccggtatgcccacccaggggccgaacaagatgccgccggccaggatggcgatggtgcggacattgaccagcgagccgtccaccggaatgccggtataggtgctgaacacggcgaacaggcagaacagcagcgacacgccggccaattccgccggggtgtggcgttgctggcgcaacaggtcctggaacggccggatgcgggtgaggaagaacagcgccatcagcatcagcgccgcgcgctcgaacaccgcgagcagcaacatattcgggttgttttctatcatcggaaacagagccgcggcggcggctgggcaagcggtgaaaacggaatggttgccgtcattttaaagcatgagggggaagggagcagcccgacggccaataaaagaacatgggcatgccggggccggaagcccgcaggcctccggcgatggcgggtttacgcgcgggtttggaccagcgggaagtccaccgcggtggcggcggcgttgttgatgtagttggtcaggatattgagcgctaccaccgctacgatttccagcgtttccgcctcatcgaatcctgcctcgcgcaaggccgccagctcggcgtcggccacgcggccgcgctgttccgccacattcagcgcgaagcgcagcgcggcggcctgtttggcgtcggcgctggaaaaatcgcgcgcggcgacgatttcgtcatcgccgagcctggccacatgtttggccagatagctgtgggcggacaggcagtagtcgcagccgttgaattcggctaccgccagcgcgatgcgctcgcgcagcgcggcgcccagcctgcccttgcccagcgcgccgttcagcgacagatacccttccagcgcggcagggctgtgggccagcagcttcatcagattgggcaccatgcccagttgttgttgcacggcggccagcagcggctggctggcggcgggaatgtgttcgggggcgggaatggcgatgcggttcatggcaagactcctgggtggatgcggaacgtttccgcgatgggtgtactttgccaaattcttcattttggaagaatatctgttttctagaatggattatttcagtatgaggaatagcggatggaccgattccacttgatgagcgtgttcgtcgccgtggctgaggaagagggtttcgccggcgcggcgcgcaggctgaaagtgtcgccgccggcggtgacgcgcgcggtggcggcgttggaggaaagcctgggtgtgcgtctgcttaaccggaccacgcgctatgtcagggtgaccgaggccggcgcgcgttatctggacgacgcgcgccgcattctggcggcggtggccgaggcggaggatgcggcggcggggggcaacgccgagccgagtggcctgatccgcctgaccgcgccggtgttgttcggccggctgtacgtgatgccggcggtggtggattttttgcgccagcatccgctggtggaggtgtcggcgcagctgcgcgacaacgtggtgaacctgatggaggaggggctggacgcggcggtgcgcatcggccacttgccggattcttcgctgcgcgcgctcaaggtgggcgaggtgaggcggctggtgtgcgcggcgccggactatctggcgcgccatggcgcgcccgccgcgcctgaggatttgcgggagcacacggtgattgcttccaccgccgcgtcgacctcgctggagtggaaattcggcgcggacggcgagcggcgggtgcgggtgaggccgcggctgacggtcagcggcaacgacgcggcgatagacgcggcgctgagcggcttcggcttgatccgggtgatgtcctaccaggtggcggaggcgctggcggcgggcgagctggaacgggtgctgacagcttacgagagcgcgccgctgccgatacacatcgtccatgccgaaagccgttacggctcgacgcggatgcgccgcttcatcgacctgctggccgaacggctgcgcgccgacccgcggcttaaagattgatttccagcttgtccgcgccggcggccggataggcgcagcacagcaggatgtcgccggcttgggcggcgtactcggggggctgcagataggtggccgcgccggacagcagaacgccgcggcagctgccgcaagtgccgccgcggcagctgaagtccggattcaggccgcaggactcggccaattccagcaggctttggcccggttgccactcggcgtcgatggcggaggcggcaaagcgcaccggcaccgcgtgatcggccggcggcggcagggcctgggtggccgagccggcgcgcttcagccctgccgggccgaaggcttcggcgtggatgcgcgcgtctgtcacgccggctgcgatcaactcgtcgtacagcgcctgcatgaagccggccgggccgcacaggtagaagtcgccatcaagatcggcgcctgattggcgcagcagcgcgaggtcggcgcggccggcgtgctggtagtcgacgccggcgcggctggaggtttccggccggctcaccgccgtcacaatgcgcagcttgcccgcggattgacgccgcagctgttccagctcggcgtcgaaggcgcgctcggccacgctgcgggtggcgtaaagcaacagggtgggcggcatggcggcgggctgcccggccagttggtgcagcatcgccagcaacggagtgatgcctatgccgccggccagcagcgcgatggggcgccgcggcggcagcagtatgaaatcgccgcgcggcggcagcgcttccacgatgtcgcccggcgccagctgatgcagccgggccgacgccttgccctgcagtttgacgctgatgcggtagccgcctgtctgcgacagcgtgtagttgcgcagcctgaccccgtccacgccggccaccttgacgctcaggtgctggccggggacgaagggcggcggcgggctgccgtccgccggctccagatagaaagagcggacttgcgggctttcctccaccacccgcgccacccgcaagggcagccattgccgggcggcggtttgcggccaggcgccggtggccagcgcatatggcgaaaactcccgcagctgccagcgcagggccagcgcgttgcggcggcgcaccacccgctccgcggtgacgcgccatagccgctcggcgccggcgaagccttgcccgtcttccggcagcacttccgcgccaccgcacagctgcaaggtgtcgccgctggaaaaatcgatgaacagcaggccggcctgcggatgccgcagcagattgcccagcgtgttgaagtagccgttgccggcgaagtccgggatggtgagggtgtcgccgtcgacgcggacgaagccgggtttgccgccgcggtgggagatgtccacttgccagttgcttgcgccgggcgccgcgctggcgacgaagaaagtatcggcggcggcgatgaaggcgcgggcgtcgtcgtccagccggtccatccattccacggtgccgacgatgcggccgtcgggcgggcgggcgaagctgaattcgcgcagctggatgtatttggggcagttgccgaacgattgttctgccgccagcgtgaagccggcgtcgtcaagctcggccagcgcgccgttcaggcggttgcggcggcgggtgtgcagctctatgcccaagagcgccagctgcgcgccggcccgcaggcagtcgcgcagcggatcggcgcggctgggcaggctgtccacccgcagccggcgcgggtcgggcgagcgggcgaagccgggctggctttcgatcagtccggcccaggggcggccggcctcgtccaccgccgccgccgccagaaacggcagttgcgggaagaagtcgcggtgctgctgcggcatgtggtcgcggatattgcgcggaccggccgccgccatccgctccaggctgccggcgcggcgctgcatttccagctcgcccgcgtgccaggggctgggggttttggcttcagccatgccgctagacgccattcagcttgcggtgttggccggcatcgccacgaagccgggcagcgcctcgacgcgggtcagccaggcgcgcacatgcgggtagggcgccagcgggatttcgccttccggcgcgtgcgcagtgtaggtgtacagcgcgacgtcggcgatggtggcggcttggccggccaggaacggccgttccgccagttcttgctccatcacttgcagcagcgcttcggcgcggctgacagccagcgggtagtccagcggcacgccgcgccatttgtgcagccgcgcctgcgcggcgccgaaggccagcgggccggcggcggcggacagccagcgctgcacttgcgcttcggcggcggggtcggccgggatccaatcgccatggccgtagcggcgcgccagataaaccaggatggcgttggagtcggcgatgacggcgtcgccgtccaccagcaccggcacctggccgaagcggttgcgcttcagatatgccggctgcttgtgctcgccggccgccaaattgaccaggatggcttcgtattccaggcccagcagagacagcatcagccgcgcgcgatggctgtggccggacagggggaagtcatatagctggatggcgctcatggaggtttcctgtattggggggcgatgtcactgtgccagcaaatggtcttttcaagaatgcctgaacaagacaatagattattccgccgcttgcaataaagccagcgcggcgtccaggcaggatggcaggaggtgcttccattttgacggcaatattgatgcgcaatctcaactgatataaagcacgaatgatcttttgtgccgcattaaacataatcgtgtgccactgttttcggcagaaaaagatactttcactcaagtttgactacttggagtccgtgatgaacattcggcaggcgatattgggcggtttgatcggcggcatggctgcgggaatgggcggggcggcctgggccgcggagcgcgtcgatctggcggcggccggggcggcgtttcccggcatcgagcaggcggggctgaaggcgcagcgcagcgcgcagtttcccgacggcaaggtggtgacgcgctaccagcagtactaccagggagtgccggtatggggcgaggcggtggtggaggataagcgtcccggccagcccgcgcagtacagcggccgttatatcgcggggatagaggccgatctggcttccgcgcagcccaccgtgaagcgcgacgccgcgctggcgcaggccaaggcgttggcggcgaacggctatcccacccgcaacgacaaggctgagctgtgggtgcgcgtcaacgaaagcggcgtcgcgcagctggtctacctggtttccttcgtggtggaaggcggccgcggccccagccggcccaatttcttcatcgacgcgcatggcggccaggtgctgcagcgctgggaaggcctggcccatgccgaggccggcgggccgggcggcaacgtccgcaccggcaaatacgtttacggcaaggactacggccccttgatcgtcaccagcgattgcgcgatggacagcggcgaggtggcgaccgtcaacctggcgggcggcacccgcggcgacgcgccgttcaagttcgcctgccccaccaatgattacaaggcggtcaacggcgcgtactcgcccttgaacgacgcgcactttttcggcaacgccgtggtgaaaatgcacaaggcctggttcggcgccgcgccgctgcggcagaagctgtacgtcaaggcgcattacggcaacggctccgaggcggcgttctgggatggccaggcgctgaatctgggcgatggctccagccgcttctacccgccgacggtgctggacgtgatcgcgcacgaggtgcatcacggcttcaccgagcaaaattccggcttggtctaccagggccagtccggcgccatcaacgaggcgttttccgacatggccggggaggccgccgagtattacctgcggggccggaacgactggctggtcggcgcggaaatctacaagcagggcggcgcgctgcgttatttcatcgacccggcgcgcgacggacactcgatcggccatgcccgcgactaccgcgacggcatggacgtccactacgccagcggcgtgtacaacaaggcgttctatttgctggccactcgtccgggctggaacacccgcaaggcgtttgaggtgtttgccgacgccaaccggctctactggacggcgaatgccactttcaatagcgccgcttgcggcgtgagccgcgccgcggaaacgcgcggctacggcaagcaggacgtggcgcaggctttcgccgcggtgggggtggtttgcgccgcttgagcggcgtgcaggcttgattgtcgctattcggcgcgggcggcggatcgaggctgcatccgccgctccgcgccggatttatcttttgccgctggccgccgtcgcatcctccagcgcggcgagcagctccgccagccgtttttccagcgcgtccaggctgcgcgggggcagcgccgacaaaatggcgtgctcattggccacatgcgcttccagcgcgcgctcgatcaaggcgaagccgacttcgctcagccgcaccagcgtgctgcgcgcgtcttgcgcgctggcctcgcgcgaaatccagccttttccttccagcactttcagccggtgcgtcatggtgccggatgtcaccatcaaggacgaaaacagctcggtcggcgccaggcaatagggcgcgccgctgcgccgcagcgtggccagcatgtcgaactcccagccgctcagcccgtattgtccgaacaccgcgtccatccgttgcgacagcagcgccgcgcagcggttgaggcggcctatcacgcccatcgggctggcgtccagatcgggtctttccctggcccattgcgccagaattctgtctaccgcatcgccttcccgttgtacggccattcatgttccttgtcttgaattcaagatttatttgccttgaattaaagataaatgttatcttgaattcaagttaattgatctcgattataaatcgaatggaaaggcttgcccatgtctcttcggcgcgcatccgctctgtggagcgatgtcttgatcaccgccatggtgccggtgatctggggttctacctatatcgtcaccacccagttgctgccgccggaccggcccttcaccgccgccttgctgcgcgtgttgcccgccggtttgctgctggcttgcctgggcggctggcggccggccaaggggcagtggggaaaattgctggcgctgtcggcgttgaacatcggcgtgttccaggctttgctgtttgtcgccgcctatcgtcttcccggcggactggccgcggtggtgggcgcttgccagccgctgctggtgatggcgctggcctggcaggtggaaaagcgcaagccggcgcggctggctttgtgggccagcttgagcggcgtagccggcatggcggccttgctgttgtcgccgggttcgcgctgggacggcttgggcatgctggcggcgttcggcggcgcggtggcgatggcctgcggcacctatctgacccggcgttggcgtttgccggtgccggtggcggccttgaccggctggcagctgactttgggcggcctgatgctgctgcccctggcgcggatcatcgatccgccgttgccggttttgaccgcggcgcagatcggcggctatgcctatttgacggttttcggcgcgttgatcgcctactggctgtggtttcgcggcatcgcccgcttgtcggcggtggcggtgacatcgctgggcctgctgagcccgttgacggcggtggtgctgggctgggccttgctgggccaggccttgtcggcgcaatcgatgctgggcctggccattgtgctggccagcgtgctggcggtgcagtggagcatgctcaatgccgcggccaaataagaggtcttatggcttggacgacgcggtaggcgtcagccgcgccatcatcaagacatccttgtagcgcccatcgatgcagatcgcctcgcgtttgcggccttccagcagaaagccgtgtctttcgtagagcttgatcgcgttgaggttgtcttcatgcacggtcagctccaggcggcgatagccgcgctgctcggccaattgcaatgtgctgtccagcagccatccgcccaggcccatgccgcggtagcgcggcagcaggcccatgcccagcgtgccgccatgctggtagatgggaaagtgctggggggcgacatcgcaccagccgacgacctgcttgccgtccagcagcagcaagtgcggggctttccgggccaattggctgcgcgcgtattcggccgaagccgcttgcgggatttccagaaaggccaggtagcgccgttctcgggccacgctgtcggtgacgcgccagaaattctcgatatgctcggcgctcaggtgtcgcagggaaaatgcagtggtgtagggattgggcatggcaatggccttctttgagagggccattttatggagtgggagatgacgttgcaatattgctgtcggtcaggcggctgtgctctggctgccgatcacgttgcggcaatggttttccagcgcgccgatttcgtccagcaccgcgtcgatgtcatggcgctgcgattccagctggttgcggcgggactggagcagatccagcagcttttgcgactggctggcttcatcgcgcgccaattggtacaggtcgatgatttcgcggatctccgccagcgacaggccgatgcgcttgccgcgcaggatcagcttcagacgggcgcggtcgcggcggttgaacagacgctggcgtccttcgcgctggggctcgatcagcccttgttcctcgtagaagcggatggtgcgcagggtgacgtcgaattcttgcgccagatcggagatggtgaaaaattctgcttggttcatatgttttccttcaggcggcgattgtagcgtttttcccactccaacagatgaaagcttgatttacgtttacgtaatcgtcaacctgtgtcttcgcgcaaccgacacggggaaccgtcgatgcaacaggccagctacgcccagggggccagcgatcagccgctattgggacagaccataggacgttttttcgaccaggcttgcgaacgccatgccgaccggctggcgctgcgcgtgcggcagcaggacatccgctggagctacgccgaattgcggcggcaggtggatcggctggcctgcggcttgctgcggctgggcctggccccgggggagcgggtaggcatctggtcgcagaaccgcgccgaatgggtgctgatgcagttcgccagcgccaaggccggcctggtgctggtcaacatcaacccggcctaccgccgcgccgagctggagtacgcgctgaacaaagtgcagtgccgcgcgctggtgctgtcgcccggcttcaaaagcagcgactacgtggagacgatgcgccagctggcgccggaactggacgcctgcaggccgggcgagctgcgcgcggggcgcgtgcccgagctgcgctgggtagtgcggatggggcagcaggcgctgccgggcatcctgccgttttccgagctattggccgagccgacggcggccgagctggcggcgctgcaggcggtgggcgaggcgctgcagtgcggcgacgcggcgaacatccagttcacctcaggcaccaccggccatcccaagggcgcgacgctgtcgcatcgcaatattctcaacaacgcctggttcgtcggcgcggcgatgcggctgcgcgccgacgacaggctgtgcattccggtgccgctctaccattgcttcggcatggtgatgggcacgctgtgctgcctgtgccgcggcgcggcgatggtgctgccggcggagggtttcgacgcgctggcggtgttgcagacggttgccgaggagcgctgcaccgccttgcacggcgtgccgaccatgttcatttcgctgctggaccacccgcgcttcgccgaattcgagctgtccagcctgcgcaccggcatcatggccggcagcccctgcccggtggaggtgatgaagcgggtgttgtcgcagctgcacatggccgaggtgaccatctgctacggcatgaccgaaaccagcccggtcagcctgcaaagcgccgccgacagcccgctggagcaaagggtgagcacggtgggcggcgttcatccgcatgtggaggtgaagatagtggacgccgaggggcgcgtcgcgccgcgcggccagcgcggcgagttgtgcgtgcgcggctactcggtgatgctgggctattgggacgatccggacatgacgcgcgccgccatcgatgcggaaggctggatgcacagcggcgatctggcgatcatgcgcgacgatggtttggtcaacatcgtcggccgggtcaaggacatggtgatccgcggcggcgaaaacatctatccgcgcgaggtggaggagttcctctaccgccatcccaagatccaggacgtgcaggcgataggcgtgccggacgcgcgctacggcgaggagctgtgcgtgtggatacggctgcgcgacggcgaaaccgcgaccgaggaggagatccgcgccttttgccagggcgagatcgctcattacaagattccgcgttacatcgagtttgtcgatggctttccgatgacggtcaccggcaaggtgcagaagtatctgatgcggcggaaaatgctggaaaagctgggtttgccggatgtcaaaacagcctgattccagaccgtccaggcagcgaaatgccggccagaagcgcgcttttggcttacaatgcgcccagacctgattcacccttgaggaatacaccatgaccgttaccgctttcaacgatgccgacctggcccgtctcgaaacgctgttgaccccgttgtccgccagcggcagcaccatgcgcccggacgaagtgcagggcttcttcgccgcgttggtgagcggaccagatgcggtcgataccgatttctggctgccggaagtgctgggcgacgcgccggctttcgaaagccaggccgatgaagccgagctgaaaaccctgctgcaaaagctgttcgacaccacccgcgacgtgctggccgccggcgaagagctggacatgatcttgtacgcggaagaagacagcgaagaagagggcgagccggactactggccgtgggcgaacgcctacctgtacgcgctggatctggtcgacaccgactggttcgaagtggcggaagaggacgagggcttcgaaagcctgatgatgccgatgctggtgctgggcggcgcgttcgaggaagaagacggcgaagacctgctgactttcaccgacgaagaggtggaaggctacaaggaagagctgaccgacgccctgcaggcggtgttcggctactggcgcgccaaggagcaggcgccgaccacggttcgccgcgatggcgacaaagtgggccgcaacgacgtgtgcccgtgcggcagcggcaagaagtacaaggcttgctgcggcagcaactgagccggccggccgatcatgaaagcggaccatgggtccgctttttttatggccatgcatccggaacgcgcgcaggcgggccccatcgacgcggagacgctaggcgcgggtgcttaggcatggcttaatatgcctttgaaattttcggccgcaagcctagcctggacccgcgatgaaccccgccctcgttttcgattactacaatcccacccatcttcatttcggcgccggccagttggccggcctggagcggctgctgcctgccggcgccaggatcctgctgctgtacggcggcggctcgatcaagcgcaacggcatccacgcgcgcttgcagcaagccttgcgcggccatgactggctggagttcggcggcgtggcgcccaatccagacgtggaggctttagccggcgcgctggcgctgctgcgcgagagccggcgcgatttcatcctggcggcgggcggcggttccgtcatcgacgccgccaaatacctggcggccgcggccttgcatgacggcgatggctgggagctggtttccggcaagcagccagtgcgggcggcattgccgctgggcgtggtgctgacgctggccgccaccggttcggaaggcaacggcaccgcggtgatttcgcggctgtccagccaggagaagctggcttttcgctcgccgctgctgcggccgcgtttcgcggttctcgaccccgacaccctggccaccctgcctgaccggcaactggccaacggcgtgaccgacgccttcgtccatgcctgcgagcaatacctgacctacccggtaggcgcgctggtgcaggatggctgcgccgaggcggtgctgcgggcgctgtaccggctggcttgccgtttcgacgagcgcggcacgccggactggcggcagaacatgatgtgggccgccaaccaggcgctgtccggcgccattggcctgggggtgccgcatgactgggccacgcacggcatcggccgggcgctgaccgcgctgtacggcatagaccacggccgcaccctgtccatcgtacagccgtcgctgctgcgcgaggcctgcgcggaaaaagccgccaagctgcgccagatgggcgcgcgggtgttcgacgctccggaattggccgcggagcgggtgatagacaaggtggaagacatgtatcgcgcgctcggcatgccggtgacgctggccgaggccggcgtgccggatgccggggcggccgccgacgatgtgctggccttgctgcggcgcgacggccggttcggattgggggagggcggcatcttgatcgaggcgcgcgtcggccgcatcgtgcgggcgttttgccgctgaggctagttttgcgccaggcgctcgcgcagcaaccgggccgtcagctggcacaggccctgcagctgggcggcggtggctggcggataggcattcagttgccgcagcacctggcaggtttcctgatggccgcgctccagcccggcctcggccagcggcgcgaaggcctggccggcttcctgccgcgccagttgcggatgccggccgcaatagtgctcgaacagggccgcgatgcccagcagcaggtgctggctgtggctgtcgcccggcagcgcgctttcctgcagctggcccgggtcgacgtccagtccggccagttgcgcgacttggtccatcaccgcgctgtacagcagctgggcggcctgccggccatggctgaggctgatgtcggcattgtcttccgtgtcctggcggcgcccgcgctgtccgtgctgggccagcgcgtgcacgccgcgcgcccccccggcgcgcgggtggacgccgcctatcggcgcgacgatgatgtcgtcatcgattgccatggccgactcccgcggtcatgcctgctcagctgccgctctggctgtcgccggcggccgcctgcgaggactgcgtgccggcggactgattctgctgcaggaaggcgtccagtccctgctcgaccaggtcgtgggtttgctggatgccgctggagacatcgccgttgaagacattgaggtttttcaggatgccggtggcctcctgataaccttgctcgaagccttggcggatcagcccgacgaagttttgcgcctgctggtcggagctcagctccgggtgctgctgcttgtacaggccgaacaggctggtggcgccgtccaggatgcgcttggcggtggcttgcggcgaattgtcgtcgtcgctgttctgtccgctttgctgctgcaccgaaatgctcagctgcgtgctgttgatctgcagcgtggacgaggaggcgttgccgctgccgtcgctgttttgtccgccgctgtcggcgctgaggatctggttgatattggtgatcgaggcgtggaacagcagcgtttgcgattgcttgccgctgctgatggatacgtccagcgactccaccagcaccgagttgagctggttgcgggcagtctgggcgctgtagccggcgttctgcgtctggctggcgccgccggtctggccggcctggttgctgttcagcgatgagatcgacatcacggactcctgtcggcgcgtctctgcaatccggcgcactgtatagggttgagggaacgacttcagtatgacctgatttcggcagcggcacggaaaacttgtggattgccgattcgggctaggtggtttcgctgaagaaaaagcaacaggccgcatgcctgcatggcatgcggcccgttcgcggcgcaatccgcggcgtcatatcagaagccgaagtgcgcttcctccagcgccatcagcggcttggcgcccgttttgatgctggccttcagcgcttccgcttccggcagcagcttggcgtagtagaagcgggcggtggcgatcttggcgttgtagaacgcgtcctcgccctggcccagcttggcgtaggcgacttcggccatccgcgcccacagccaggcgtaggtcaagtggccgaccaggcgcaggtagtcggtggcggcggcgccggcctcatccttgttggacaggctggccatgccgatgcccatggtgatctcgccgatttccttcatcagcttggcgagcggattgacgaattcgcccaactgcgcatggccttcgtactgctggcagaacttgtggatcagcttggtgaatttgcgcagcttggcgccctggtccagcagcactttgcggcccagcaggtctatcgcctggatgccgttggtgccttcgtagatctgcgagatgcgggcatcgcgcaccagttgctccatgccccattcgcggatgtagccgtggccgccgaacacttgcatgcccagattggcggcggtgtagccgttgtcggtcatgaaggccttggccaccggggtcagcagcgccaccaggtcggcggcgtcggcgcggacgccggcgtccggatgcttgtcctctatgtccagctgcagcgccagcagcgccgccagcgcgcggccggcttcggtataggctttctgagtcagcagcatgcggcgcacgtccgggtggacgatgatggggtcggcagccttgtccggacactgcgcgccgttcagcgcgcgcatctgcagccgttcgcgggcgtaggagagcgcgccctggaacgaggcttcgcctatgcccaggccctgcatgccgcagcccaggcgggcggcgttcatcatggtgaacatgcaggacaggcccttgttaggctcgcctatcagccagcccttggcgccgtccagattgatcaccgcggtggcgttggccttgatgcccatcttgtgttccaggctgccgcaggacacggcgttgcggctcttgtcgtcgaggaatttgggcacgatgaacagcgagatgcccttcacgtctttcggcgcgtccggcaggcgggccagcaccagatggatgatgttgtccgataggtcgtgctcgccggcggagatgaagatcttggtgccggtgatgcggtagctgccatcgccgttcggctcggccctggatttgagcaggccgaggtcggtgccgcagtggggttcggtcaggcacatggtgccggtccagctgccgtccaccagcttgggcaagtaagcggctttctgttcttctgtgccgtgcgcgtggatggcagaatacgcgccatgggacaggcccggatacatcgaccaggcgacgttggccgagcattgcatctccatgatggggaaggccaggctcttgggcatcccctggccgccgtaggacggatcgcagtccagcgccgggaagcccagttcgcagtactgtttgtaggcttccttgaagcccgtgggagtggtcaccgatttggtcgcgctgtcgtactggcagccttcttcgtccgcctggcggttgagcggcgcgagctcggactcgcaaaactgggccgccgcctccaggtaggagctgaagatgtcctgcgtggcctcttcgtagcctggcagagaggggatgatgtcctgtaccttgatcaactcgttgagaacaaagtcgaagtcgcgcagcggtgctttgtagacaggcattcggtttctccagtgggttggcgcggcctggtgcatgccaggtcgatacgctttatgatgaccccttggccggggcggtttaattcaaacgcttgtttagattattcccggccttttgacaacaaaatgcgttgccgcgcgcgggcgggtgtggcattacgacaacgtagcggcatgaaaatggaatgacctggctcaagcggaaaatgcggcggttcgccggacggcgccaccaatggttcgcccggccgggcatgcgccggctggcgccgtatctggaccagccggcctattgggcgttcaatcggcgcaaggtggcgatgggcgtggcggtgggactttattccggcgtgatgccaggcttcacccagaaggccaccgcgctggcgctggcgctgctgctgcgggtgaacctgccggcggcgatggtggtttccctgtacagcaatccgttgacggtgttgccgctctattatctggcctactgttatggcagatggctgctgggcggccccacctccctgtcgatggcgccgcctcccggcctgggcggagcgggcttggcggcttggctggccggcacggtcggctggctggtggacatggggtggccgctgctggtgggcatgccggcgctggggctgaccctgggggcggcgggctatctggcgacgcgagtgatgtggcgctgggctgtagtcagcgcctggaacaatagaaaggcgaagtgtggatctgcttgaaaaacaattgacgtcggagctggtgtacgagggcggcttcctgcgcgtgcgcaaggaccaggtggcgctgcctgatggcaagcaagccgcccgcgagtacatcctccatcccggcgcggtggccatcctggccctgacgccgcagcgcgagctggtgctggagcggcagtaccgctatccggccggccgcgagttcatcgagattcccgccggcaagatcgacccggacgaggcgccggaagagaccgcgcgccgcgagcttttcgaggaaaccggctatcgcgccgccagctggacttatctgggcaccgcccacccctgcatcggctattcgaatgaaaaaatcagctattacctggcgcaagatcttattcttagcgaaaggcggctggacgagggcgagtttctggaggtgctgaccaagccgctggacgaagcgatggagatggcgctgagcggcgggatctgcgacagcaaatcgatagtcggcctgcactggctggcggcttatttgagcgggaggatgcgaggtgtcccgatttgacgcgtattacgaccgtcggcgcggccgacgcgtcagcatggggtgcaaggcccggatcaagtcgctgttgagcgggcagacctattacggcgagtgcgtggacttgtcggtggacggcatggcgctgcgctcagcctttgtgccgcagtacggcgaaaagctcaatgtgatcgtgctggtgcccagcgtgggcggggtgtcgggcaagccattcgaggccgaggtcgaggtcaagcgctgcaatgaagtgcagcgtggactcatatatgaaatcggtgtccgcatcctgcagagaaaaagctgacaagcctttgtaatttcagatttttatatccaattattcctttcggcattacaagaatttactaagcttcatcaattgttacaaaattccaaaattaaaaatccttattgattcaacggcttttcccacgcgatgccggctgtgctggttgattccagtttttgccggcttttgtccggtcgtttcgtactgctatgctatacccaaaaaaagaccggagacacagtcagcactctaattcagcaaggggaacggcctcatgcgaggtgcatttcgcccagcccctgctaccagccaggagagagtcatgcacccggatatcttcagtcactacgcagtgcgctacgacaagacccgcgaggaagagtacacgatccaggagtatctggagctgtgccggcaagaccccggagcctacgccactgccgcagagcgcatgctggcagccatcggcgaaccggagctggtggacacccgccacgactcccggctgtcgcgcatcttctccaacaaggtcatcaaggtatatccggccttccgcgacttctacggcaccgaggaagtcattgaacaggtggtcgcctacttccgccatgccgcgcaagggctggaagagaagaagcagattctctacctgctggggccggtgggcggcggcaagtcctccatcgccgagaagctgaaggagctgatggagctggtgccgttctattgcctgaagggcagcccggtcaacgagtcgccgctgtcgttgttcaattacgacgaagacggccccatcctggaagaacagtacaatatcccgcgtcgctaccttaagggcattcccagcccctgggcggtgaagcggctgcatgaattcaacggcgacatcggccagttccgcgtggtcaagcgctatccgtccgtgctgcgccaggtggcggtggccaagaccgaaccgggcgacgaaaacaatcaggacatcagctcgctggtgggcaaggtggacatccgcaagctggaaaaatacgcgcaggacgatcccgacgcctacagctactccggcggcctgtgcctggccaaccaggggctgctggaattcgtcgagatgttcaaggccccgatcaaggtgctgcacccgctgctgaccgccacccaggaaggcaacttcaagggcaccgaaggtttcggcgcgattccgttcgaaggcatcatcctcgcccactccaacgagagcgaatggaagcagttccgcaacaacaagaacaacgaggccttcctcgaccggatctacatcgtcaaggtgccgtactgcctgcgggtggccgaggaaatcaagatctacgacaagctgatccgcaactcctcgctgggcaaggcgccgtgcgcgccgggcacgctgaagatgatgggccagttcgccgtgctgtcgcggctgaaggagccggaaaactccagcctgtacagcaagatgcaggtgtacgacggcgaaaacctgaaggacaccgatcccaaggccaagtcgctgcaggagtaccgcgactacgccggcgtggacgagggcatgagcgggctgtcgacgcgcttcgcctacaagatcctgtccaaggtgtttaatttcgaccacagcgaagtcgccgccaatccggtgcatctgctgtacgtgatcgagcagcaggtcgagcgcgagcagttcccggccgaaaccgaacagaagtacctgaccttcctgaaggagtatctggcgcccaagtacgtcgagttcatcggcaaggaaatccagaccgcctatctggaaagctattccgagtacgggcagaacatcttcgaccgctacgtgaccttcgccgactactggatccaggatcaggaataccgcgatcaggacaccggcgaaatcttcgaccgcacctcgctgaacgcggagctggaaaagatcgagaaacccgccgggatctccaaccccaaggacttccgcaacgaaatcgtcaacttcgtgctgcgggcccgggccaacaacggcggcaagaacccgacctggaccagctacgagaagctgcgcacggtgatagagaagaaaatgttctccaacaccgaagagctgctgccggtgatttccttcaatgccaaggccagcgccgaggacgccaagaagcacgaggacttcgtcaaccgcatggtggaaaagggctataccgccaagcaggtgcgcctgctgtgcgaatggtatctgcgggtgcgcaagtcctcataagccgtcatgaaccgctcgctccgattggagcgggcgggttggcgatgtccggcggttgacgccggtcgacaaggagacacaaccgcgcgcggcgtcgggcggcgggtttcggaacggaaccggccgcccgcggctgcgcgcaagagaggtggctatgtcccacatcatagacagacgcctcaacggcaagaacaagtcggcggtcaatcgcgaacgctttcttcgccgtttcaaggcgcaaatcaaggaagccgtctccaaggcgatcaagggacggagcattaccgatatcgaaagcggggaaaaggtctcgataccggtcaaggatatttccgaacccaatttccatcatggcaagggcggggtgtgggagaacatccacccgggcaatgaggaattcatcaagggcgaccgcatcccgcggccgcagggcggagcgggcggcgggggcagcaaggccagccaggacggcgagggcgaggacgatttcgtgttccagctgtcgcgcgaagaattcatgaacgtgttcttcgatgatctggcgctgcccaatctgatcaagacccagctgatgggaatcgaggagctgaaaaccgtgcgcgccggctacaccaacgacggcacgccggccaacatcaatatcgtccgctcgctgcgcggcgcgctggcgcggcgggtggcgatggcggcgcccaccttgtcgagcctggacgacgccgaggaagagctggacacgcttatcgagtcggacgacgacaacgcgctggatgtccgcgaaaagcgccagcgcatccaccagatgcgcgagcgcctggccagcatccccttcatcgatcccttcgacttgcgctacaacaaccgggtcaagcaacccaagccgacaagccaggcggtgatgttctgcatcatggatgtgtccggctcgatggatgagcagaaaaaggacatggccaagcgtttcttcatcctgttgtacatgttcctgcagcgcaattacgaaaagatcgaggtggtgttcatccgccaccataccagcgcggttgaagtcaacgagcaggactttttccactcgcgcgagagcggcggcacggtggtgtcgtcggcgctcaacctgatgagcgacgtcatccgcaagcgctatgccagcagcgagtggaacatctacgccgcccaggcatccgacggcgacaactgggacagcgattccgccaactgcggccgcatcctggaggagaacctgctgccgtactgccagtacttcgcctacatcgagatcaccgagggcgagccgcaaaacctgtggtacgagtacctgaaggtcaagtcgcaatgcccgcagttcgcgatgcagaaaatccgctcggcgtcggacatctacccggtgttccgggagttgttcaagcgccagccagccaatggaagggtcggcacatgaaacggactcgcaagggggaagaggaggtcggcaagccgatttccaccggttcggaatggactttcgacctgataggcgaatacgaccggcagatccgcaccatcgcggtggacgaattcaagctggacgtctaccccaatcagcttgaggtgatcaccgccgagcagatgatggacgcctacgcctcggtcggcatgccggtcaactaccaccactggagctacggcaagcatttcgtctccaccgagaaaagctacaagcgcggccagatggggctggcctacgaaatcgtcatcaattccaacccctgcatcgcctatctgatggaggaaaactccatgatgatgcaggcgctggtgatcgcccacgccgcttacggccacaacagtttcttcaagggcaattacctgttccgctcctggaccgacgcgtcggccatcatcgattacctggtgttcgccaaaagctatatcagcaagtgcgaggagcgctacggcatagacgaggtggaggagctgctggactcctgccatgcgctgatgaactacggcgtcgaccgctacaagcggccgcagaaactgtcgctggccaaagagcaggcgcggcaggaggagcgcgagcaatacctgcagatgcaggtgaacgacctgtggcgcacgataccgaagcgcgacaaggacgacagcggcaagccggcgtcgcgcttcccgctggagccgcaggaaaacctgctgtacttcatcgagaaatcggcgccgttgctggaaccctggcagcgcgaggtggtgcgcatcgtgcgcaaggtcgcccagtatttctatccgcagcgccagacccaggtgatgaacgaaggctgggccaccttctggcactacaccatcatgaaccggctgtacgacaagggcctgatcaccgacggctacatgctggagtttctgcagagccacaccaatgtggtgacgcagccgccggtgacggcgcgctggtacaacggcatcaatccctacgcgctgggtttcgccatgtatcaggatatcaagcgcatttgcgaggcccccaccgacgaggaccgcgcctggttcccggaccttgccggcagcgactggcgcgagtcgctggagttcgcgatgcgcaatttcaaggacgaaagcttcatctcgcagtatctgtcgccgaagttgatccgcgatttccgctttttcgccatccgcgacgacgacaaggacgacaagctggagatttccagcatccacgacgaagaaggctaccgtgatatccgcggcaagttggccgagcagtacaacctgggttcgcgcgaacccaatatccaggtgtggtcggtcaatgtgcgcggcgaccgcagcctgacgctgcgccacgtgatgcacaacaggcggccgctggaagaccaaagcgcccaggaggtgctcaagcacgtctgccggctgtggggcttcgatgtgaagctggaaagcgtggacggcaacggcgaggtcaagcagtcgtacgaggttcaggcggtcagggatccggagatggcctgaacgccggcgggaacgccgcgatgaaagccgggcagccaaatggcggcccggctttgttttggctccgccgcactcaggcggtgccggcgacgggcgtcaggctgcagcgcgagcggtcttcgaaactgcagttgggcaggccccagccatgggtgtattgcatctggccattggcttccagccgaatggtgatttcctggcggaattgctcggtcagactgcgcggcgcgctggcgaacaccacttccagcgtgccgtgggcgccctcggccaggcgcaccgcagggtggggcaagacgaagggaagctcttccatcaccggccacaggcatagcgtgccgtccggcaggtagcccagcagggtggtttcgcggtgcagcacatcgccgctggtgccgctggctgtgtagtgcagcagcagggctctttggccgggcagcgcctgccagtgcaggcagccggtgaaggtctggtcctcgtggttgatgccttcgccacagaactggttgggaagcgattgcaaagcggcaagcagcggcatgttcaatcttccagtcgcaaatgcgagatggtcagaatggcaggtttgccgttccggcgcaatatggatcagcgttgcgggctgtcgggcagggggatgaaggcccgccatggctgttctgggtggctcagctccgccagtctgacgccgtataccgcttccagccgctcgcgccgcatcatctcctggttgtcgccgtagccggccgcctggccattgttgagcagcaacaccttgtcggcgtggcgcagcgccaggttgaggtcgtggatcacggccaggccgcctatttgcaggcggtggcatagctggcggacctgcgccatcaattcgtcggccagtccgaagtccagcgccgcggtgggctcgtccagcagcaaatagcgctcggtttcgggagagagcagcaactggcacaaggcgcgcgccagttgcaggcgctgcagctcgccgccggataattcgttcaggctgcgcgccgccagtcgttcggcgccggtcagcgccagcgcttccgaaatggcttcgcgaatctgccgcgaaggcaggcggggatagcggtaggcgccggcggcgaccagctcggcgccggtccagccggcgggcgtcaccggatgctgctcgaccaccgcgcgccagccggcttgcgcggcggccggcagatcatccagattttcgccggccaggtggatcgcgccggaatcgggccgccacaggccagacagcagcttgagcaggctgctcttgccggcgccgttggggcccagcgcgatcagcagctcgcccgggcgcagcgccaggctgatgtcctgaagcaaaagccggccgttgcggcggagggtcaatcggctggcttcaagcatggcggcgctcctgccggcgcagcagccacaggaaaaacggcgcgcccagcaagctggtgatcacgccgaccggcaactccgccggcgcgagcaagccgcgcgccagccaatcggacgagacggccagccaggcgcccaagagcggcgcggccagcagcaagcggcgcgaatcgctgcccagcagctggcgggccaggtgcggcgccatcaggccgatgaagcctatcatgccgcagccggacaccaccaggccggtggccagcgccgccagcatcacgatgcgccactccagccggcgcacggcgaagcccaggtggaaggccgtgctttcccccagctgcagcgcgttgagaaagcgccactggcggaacagggccagccagaccagcggcgcggccagcagcatcaatagcgcttgcggccactccacgctggcgaagctgcccatcagccagaaggtgacgatgcgcagcgagccgtcgggcagcatggtgatcagcagggtcagcaggctgccgagcagggtgctgaccgccagtccgctcaagatcagccggttgccgtcctgatcggcgcccaggaggcgcaccagcagcagggccgccatgccgccgccgaaggccgaggcggcgaccccgtacaggccggcgcccaggctgagcgccagcgccgatgccagcgccgcgccgctgttgacgcctatcaggccgggctcggccagcggattgcgaaagcgcgcctgcatcgccgcgccggcgctggccagcagggcgccggcgccggccgaggccagcagccggggcaggcgcaactccaccagcaattgccattccagcgccggctgaggctgcagccgccacaaactggcgagcagcagatggctgtgatggagcagggacgcgatggacgtcagcgcgagcaggagcagcagagtgagggtcagcgtgagcgcgcgcataggaaggaaagggaggggatgccccctcccggatcagcgcaggcccagcacgtcctgcatgtcgaacaggccgtgcggcttgtccgacagccagcgcgcggcgcgcaccgcgccattggcgaaggtggcgcggctggaggccttgtggctgatttccacccgttcgcccagcgtggcgaacagcgcggtgtggtcgccgacgatgtcgccgccgcgcacggtggcgaagccgatggcattggggtcgcgctcgccggtcacgccttcgcggccatagaccgcgcattgcttcaggtcgcggcccagcgcgtcggcgatcacttcgcccatccgcaaggcggtgccggacggggcgtccaccttgaagcggtggtgggcttcggtgatttctatgtcgtagccttcgttcagcacccgggcggccatgtccagcagtttgaaggtgaggttgacgcctatgctgaagttggaggcgaacacgatggctatcttgtcggccgcggcgcggatggcggccttgccggcgtcgtcgaagccggtggtgccgatgatcatctgcacctggtgctcgacgcaggccatcatgtgttccagcgtgccttccgggcgggtgaagtctatcaccacgtcggcgccttccagcgcggcgatgaagtcggaagtgatcttgacgccgctggcgcggccgcagaacaggccggcgtcctggccgacgaagccggagtcggagcgttctatcgccgcgtgcaggcgcgcgccgggggcgctcaacaccgattcgatcagcacgcggcccatgcggccggatgcgcctacgatgacgatgttttggctcatggctgtttcgtctcctgcgccggcatcgaggcgtccagttgcttggccggcggggcgggctgggcggcgccttcgacgcggtcgagcacgtcgcccttgaagtaaacggtcagcagcttgtcgctggaggtttccagccggccttgcttggtgtcgctatacttgtagtcccagcggtcggcatggaaggcgtcggtcagcagcggagtgcccagcaggaagcgcacttgcgagcgggtcatgcccggcttcagcttggcgacggcgtcctgggtcacgtagttgccctgctggatttccaccttgtgggtccagtcaagcggatttatggaactgcagccggagacggcgatgacggcggcgaaaatcagggcgcgcatgatactccgattgactcaagtgtttatgaggctgtaattaggcaaagccgtcaaaaggctttatcatgattcgaaatcgacacactttatatcacgatgagcaaagccagtcacctcaaagatatcggcctgaaagccaccggtccgcgcctgaaaatcctcgacttgttcgaggaggcggactccggtcacatgtccgccgaagacgtttaccgcaagcttctggcggagaacatcgacatcggtctcgccaccatttaccgggtgctgacccagttcgagcaggccggcatcctggtgcgccaccatttcgaaaccggcaaggcggtgtacgagctgaaccagggcggccaccatgatcacatggtctgcgtcagctgcagcaaggtggtggagttcttcgatccagagatcgaggcgctgcaggaccgcatcgccgagcagcatggtttccgcatcgtcgaccacgcgctgtacatgtacggcgagtgcccggactgcctggccaagggcggccgccgcggatgattccctggctcggtcccgagcctgtcttcccgccggtggcgcaggccttgagtcatcccaacggcctgctggccgccggcggcgatttgtcgcccaggcgcatccttagcgcctactccgaaggcattttcccctggttttccctgggcgagcccattttatggtggtcgcccgccccgcgcatggtgctgtatccgtcgcggctgagggtcagccgttcgctggccaaggcgctgcgtcgtcccgattacgaaattcgcaccgatcaggcctttttcgaggtgatggaagcctgctcccagcctcgggcgggccaggacggcacctggatcgtgccggaaatggtggctgcctactgccggctgcatcagcttggctacgcgcacagtttcgaaacctggatcgacggcgagttggccggcggcctgtacggcgtggcgatcggcaggatgttctacggagagtcgatgttcgcgcgccgcaccgacgcctccaagctggccttcgtgcacatggtgcggcacctggccacgcaaggcgtggaaatgatcgactgccagatgcataccgcgcatctggaaagcctgggcgcctgcctggtgccgcgcgatgtttttcttgctactctgaaggagaagatccggcagccgcagcccggccaaatgtgggactatcattaccgccatgagtcatcgtgaagccggccaggtcgcggccatccatttctacgccactgcgccttatccctgcagctacctgtcgggccatcaggcgcgttcccaggtagccattcccgccgaggcgatagacggcggggtgtatagccagctggtgcggctgggcttccgccgcagcgggctctatacctatcgtccgtattgcgacgcctgccaggcctgcatcccggtgcgattggcggtcgaccagttccagcccaatcgcactcagcgcaaggtgtggcggcgcggcggcgaactgacggtcgagtggctgccgctggctttcgacgccgagcactacgcgttgtaccggctttaccagcaggcgcgccatgccggcggcggcatgtctgacgacgatgcccagcagtacgccgaattcatactgaaaagcggtgtggacagccatctggccgagtttcggctggagggggcgttgaagatggtcagcctggtggaccggctggcggatggcttgtcggcggtctacaccttttacgatccggccgacgcccagatgagtctgggcgtgtacaacgtgctgtggcaggtggagcaggccagagcgatgggtttgagctatctctatctgggttactggatcgccgattgccgcaagatggcttataaggccggctatcgtccgctgcagatgctgcacggcggccgctggcagacgatgccggagccgagctaggcgcggggaaagtaaaaacaggcccttccgggcctgttttcgtttggctgcgctgcccgctcagtacggcacgacgcggtcgttgccgccgccgctcagcagcttcacgcgctggttggcgacgaagggaatgtcggcttcctgcacgatggacaccacccggccggaatccagcttgacggtgatttccagcgcgttcttgcccagcgcttcctgggcggccttggcgccgtagccgccggccagcgcgccgacgatgccgccggcgatctggcccttgccgccgccgatattgctgccggccagcccgcccagcgcggcgccgcccagggtcagcagttcattgttctggccttccatcttgacgttctgcaccgaaaccaccgtgccgaactgcacggtctgcgcctggcgcatctggcttttggaatacaccgcggcggagtccgaggtggcgcatccgctgagcgcgccgacgctcagcaaggcgatgacggtgatgcggctgagagtagttgtcttcatgttcttgctccattcattctcgtgtgcgagcttgcaggtattgcgccgccgcccgggcgcattcgccgaccagttccggcccgcggtatatcaggccgctgtacagctgcaccaggctggcgccggcttccagtttttccacggcatcgctgccggaaaggatgccgcccactcctatgataggcagagcgccgtcaagttccttggccagtttgcggatcagcgcggtggagcggctgcgcaccggcgcgcccgacaggccgccggcctcgttttccagcggatggccggcgatctcacgccgcgacagcgtggtgttggtggcgatgacgccgtcgatgccgttgccgatcagcaggcgggcgatctctgcgatctgctcgtcgtcgagatcgggcgcgatcttcaccgccagcggtacatggcggccgtgccggtccgccagctcgctctggcggcgcttgagcgcggccagcagcttgcccagttcgttgccctgctgcagctggcgcaggtttttggtgttgggggaggagatgttgacggtgacgtagctggcggcagcgtatacctgatccaggcaggccaggtagtcgtcgaccgcgttttctatcggggtgatcgcgttcttgccgatgttgatgccgagcacgcccttgaatttgcagcggcgcacattgtccagcagcgcggctacgccgaggttgttgaagcccatccgattgatgatggcttcgtgctccggcaggcggaacaggcgcggcttgggattgccgtcttgcgggcgcggggtgatggtgccgatttcgatgaagccgaagcccagatccgctagcgcgtcgacgtgggcgccgttcttgtccaggccggcggccaggccgaccggattggggaaggtcaggcccatcgcctgcaccgggtggccggcggcgggcgagcccgccagcgagcccaggtgcagccggtgcgcgcgatccagcatcttcagcgtgtgttcatgggcggtttccgcgtcgaacttgaacaacagcgggcgcagcagcgggtacagcatggcattctccgggcagacaaatgcccggcattataaccgggcatcggggcggagccagcgggaattacaggatctggcaggcgtcggcgaaatcgaagcgcggcgagcgcgggaacagcttgtcggcttcgccgtagcccaagttgatcaggaagttggacttgacgttgccttcggggaagaaggcggcatccaccgcggcgttgtcgaagcccgacatcgggccgcagtccaggcccagcgagcgggcggccaggatcaggtaggcgccttgcagcgtgccgttgcggaaggcggtggtctggatcagcgcgtcgttgccttcgaaccagctcttggcgtcggcatgcgggaacagcttgggcagttgctcgtagaatttcatgtcttgggcgacgatcacgcataccggcgcggacatggtcttgtcgacattgccttcggccaggcagggcttgagcttggctttcgcttccgggctcttgacgaagacgaagcgcgccggcgagcagttggcgctggtcgggcagtgcttgagcaggtcgaacagctggcgtagcaggtcgtcgccaaccgggcgagcctgccagtggctgtgggtgcgagcgttcaggaacagctgttccagcgtggcatgagagaggggagtgctcatggttttacctcggttgcagtggggggtgttgtctgcgcttcgggtgcgccggcatcgttggcttgcaccgaaatggtgacgcggcgattgcgggcgcggccttccgcggtggcgttgtcggcgacggccaggttggcgccgtggccgaccgccaccattctttgggcattgatgccgttttcctggaacagccgcaccacgccgccggcgcgcgcggcggacagttcccagttggacgggaaggacggggtgcggatcggcacgtcgtcggtgaagccttccaccttgatggaattgtcgacgccggccagcagcttggccatgctggacatcagcggcagcgactgctgattgggcaccgcctggccgacggcgaacagcgcgctgtcgcggatatcgatgttgatgccctggtcgctctgggtgatggtgacttcgccgctttgcaccagcggtcccagcaccttggccaggttctgcgtcagctggccgagcttggcggcttcttccacatggtggtcggccttgatgcttttggagatgggcttggtttgcggaatctcaatcatggtgttggctccgccattgggcggggaagtttgcactgtgaccagggtgccgctgcggaaggcatccatgatggccgaggacatcacccggtacttgccctcgttcagcgaggagatggcgtacatcaccacgaagaacgcgaacagcagcgtgatgaagtcggcgtacgaaaccagccagcgttcgtggttttcgtgctcgtcttcatgtcgtttgcgcctggatgccatgtcgctctccgcgttctagaacagggcggtgtcgaacagcgacttgacgccgccggcgaactgcacgcctatgcggcgcgccacccggctggaaaagtcgtcctgctgagtatagtcgacggtcttctccgccttgaccacgtcgcgggccaccgacggcacggtgcccaggccgtcggccaggcccagcggaatcgccttggcgcccagccataccatgccgctgaacatttgcggatcgttctgcaggcgcttgccgcggccgtcgcgcaccgcctggatgaactgctggtggatgtcgtccagcaactgctggcggatggcgtcatgcttggggttgaccggggagaaggggtcgcccatcgccttgttttcgccggcggtcttcagtctgcgctcgatgcccagtttttccatggcgccggtgaagccgaaaccgtcggacagcacgccgatcgagccgacgatgctggccttgtcgacgaagatcttgtcggcggcggcggcgatgtagtagcagccggacgcgcagacgtcgctcaccaccacgtagatcggaatgtcggcgtgcttcttcttcaggcggcggatctcgtcgtagaccatgcccgacagcaccgggctgccgccggggctattggcgtcgatgatgacgcccttggtgttgcggtcgcggaaggcgtggtcgagcgcgtccaccattttctggccgctgtcgttgtcgctgctgatcacgccatccagcttgatcaccgcgctgtgtccgctgccggacaggccggcgccggccttgtcttcgctgcgcatgaacaggctggcgacgacgaagccgatgatcaatagccaggccaggcggaagaagattttccattgccgggcgcggcgttgctccaccagggctgcggtggccagtttttccagcaattgacgttcccagttgggggtgtcgctcatggtagggatgctccggaacaattccaaaagtctagcaaaattcagtcaggcatgacattcagccagacttggccgttttgttcaatgacttccagcctggcgagcgattggccgcggcatggcccccagctgcaatagccgttgtcggggtggtagcgggcgccgtgcatgctgcagatcagatagtggccggtcaggtcgaacagcttgccgtcttccaggtcgagctccaccggaatgtggcagcagcggttgatataggcgtggaccttgccgcggtaacggacggcgaaggcgggcaggcggctgccatcggcttgttcgatttcaaagcggtgggcggggccgctgtccagcagctcggcggacgggcagatcagcctaggcgcggcagcagccatgagctcagctccggcagcgagtggacgagggcggcgggctggcagcggagcagttcttcgtccgcgtgcgcgccgtggctgatgccgacgcctacgctgccggcgttgcgggccatcagcaggtcgtggctggtgtcgcccaccatcagcgcgcggccgcaggccacgccgaagtagtcggtcaactggaacagcatgtccgggtgcggtttggaatggcactcgtcgacggtgcgggtggcatcgaacaggtcctggatgccggcggcctgcagcgcgcggtcgaggccggcgcggctgctgccggtggcgatggcgacgaagatgccggcggcccggatggcttgcagcgtggactgggcgtgttcgaacagcgtcacccgctccagccccgcctggtagcggcggcgaaaggcggcggtcagttcgggcaggcgggcgccggccgccgggcaggcgcgcagcagggcgtcgtccagccgcaggcctatcacgtggctggcggcctcgcggccggggaccggcaggtccagatcgcggcaggcttgctggatggcgtggacgatgtggccggtcgaatccatcagcgtgccatcccagtcgaacaccaccaggtcgaactctcgcatcagcgcggctccagggttttcaggaatttcgccaattctggcggcagcggcgcctccagcttcagcggcgcgccggtcaatgggtgcggcagcgccaggcttttcgcgtgcaggaacatccgcttcaggccgcggcgcgccagctccttgttgagcgcgaagtcgccgtatttctcgtcgccggcgatcgcgcagccgttggcttgcatgtgcacccgtatctggtgggtgcggccggtgcgcagatgcgcttccaccagcgtgaattcagtgtagcgctgctggatggcgaagttggtgtgcgcgtactggccgtcgtcgccttcggcgatcttgacgcggcgctcgccgtcggcggtgtggaatttgaacagcggcagcttcacctgcttgatgttttccggccagtggccggcgcccagggccaggtagcgcttgtcgggcacattgtcgcgcatcatgtcgtgcaggcgggtcagcgccgagcgcttcttggccagcatcaggaggccggaggtctcgcggtccagccggtgcaccagctccaggtagcgccactccgggtgggcctggcgaagttgttcgatcacgccgaaagacacgccgctgccgccgtgcaccgccacgccggccggcttgttgatcaccagcatcgcatcgtcttcgtacaccaccgggaaggtggcggcgggcacgtttttctcggcgcgctcggcgacgcggatcggcgggatgcgcagcgtgtcgccggccgccacgcggtagctggcgtccgcccggcccttgttcacccgcacctcgccggagcgcagaatgcggtagatatggcttttgggcacgcccttgagcaggcgctgcaggtagttgtccagccgctggccggcatcttctgcgtcgacttcaaggaaggttacggaatctttgcgaatgtctgtcatattgcttatacttgtggcgctgcccagctgtgcctatgcacggcgcggcggcggatttcggaaagccaaggtcacggcctgtttcgcgtgatgctgctgcggaaattccgaacggccggcagggctttcgtcctgacctgatgccgtcagcaccggccgcagccaaggttaactcgctcaccgaaaagtagcgatggtaatgcatttatacgcataacgcactcacgagtattccgtttcctgatgctaagccagtcagggaattttgcagcgaagtttgacccggcatgccagccgtcctgtcgatgtttgtcctgcctggtaggcaggatcggtacgaaaccgatgcgccgtttgcgcacagagtcggcgggctgcatgtgacccaatcaggaagtaggcttgttagcaaacctgtttttctcgatctttacatcgacacttctttcggaaagcgcccatcgatagtcactgggccgtcaaatactggctgcatccttgcgtgagtgccgcgcaaggaatgtaaatgaaacgcatgttgttcaacgcgacgcaagccgaagagctgcgcgtcgccatcgtcgatggacaaaagctcgtcgaccttgatatcgaaaccgtaggcaaggaacagcgcaagggcaatatctacaagggtatcatcacccgcatcgagccctcgctggaagcctgcttcgtcgattacggcacggaacgccacggcttcctgccgttcaaggaagtgtcccgctcctatttccagggctatgacggcggccgtccgcgcattcaggacgtgctgcgcgaaggcatggaagtggtggtgcaggtggagaaggacgagcgcggcaacaagggcgcggcgttgaccacctacatcagcctggccggccgctacttggtgctgatgcccaacaacccgcgcggcggcggcgtatcgcgccgcatcgagggcgaggagcgccaggagctgaaggatctgctgtcgcagctggaagtgccgcacggcatgagcctgatcgcccgcaccgccggcatcggccgcaatctggaagagctgcagtgggacctgggttacctgatgcagctgtggcgcgcgattgaaggcgcggccggcgcgcagtccgctcccttcctgattctgcaggaaggcagcctggtgatccgcgcgatccgcgactacttccatccggacatcggcgaagtgctgatcgacaccgaggaaatccacgaccaggcccgccagttcatgagccatgtgatgccgaacatgctgtcgcgtgtgaagctgtacaaggaccatgtgccgctgttctcccgcttccagatcgaacaccagatcgaaaccgcgttctcgcgcagcgtgcagctgccgtccggcggcgccatcgtgatcgaccataccgaggcgctggtgtcggtggacgtcaactcggcgcgcgccaccaagggcgcggacatcgaggaaaccgccgtccgcaccaacctggaagccgcggaagagatcgcccgccagctgcgcctgcgcgacctgggcggactggtggtgatcgacttcatcgacatggaaaacgccaagaaccagcgcgacgtggaaaaccgcctgcgcgatgttctgaagcatgaccgcgcccgcgtgcagatgggcaagctgtcccgcttcggcctgctggagctgtcgcgtcagcgcctgcagccttccctgggcgagaccagccacgagccatgtccgcgttgccacggcatcggcttcatccgcggcaccgaatcgtcggcgctgcacatcctgcgcatcatccaggaagaggcgatgaaggaaaacaccggcgcggtgcacgcgcaggtgccggtcgatgtggccaccttcctgctgaacgaaaagcgcgccgagatccactcgatcgaagagcgtctggacgtcgacgtggtgctgatcccgaacatccatctggaaaccccgcactacaagatcgtgcgcgtgcgccacgacgatctggccgaactgggcgaagcgccgagctacagccgcgtcgaagtgcaggaagaggatgtgatcaccaacttcggccaggaaaagccgaaggtggagcgccaggaagccgcggtcaagggcatcaccccgcaacagccggctccgaccgccgcgccggcagccgccaagcagccggctgccgaggcgggcctgttctccggactggtgtcgtggttcaagggcctgttcgccgaaccggaaaaggcgcccgagccggaagccaagaagaagccggcggcggcgcgcgagcagcgcggcaaccgccagcgcagccaggagcgccgcaccggcggccaggcgcgtcgcgagcacgagcagcgccgcggctccccgcaggatgagggccgccagcgtcgccaggacgagcgcggcgagcgcaaggacgccgagcgcagcgaacgcgccgatcgcgctgaacgcaaggatccggccggccgcgaagcacgcgaagagcgcaacgagcaggcgcgcgaaccgcgcggcaaccgccgccgcgaacgcgaaggccgcgaaccgcgcgaagcccgcgagccgcgtgaacagcagccgcgcgaagagcgtgtgagcgacaaggccgagaagcaggacaagccggaaccgcgtcgtcgccaggcgccggccgccgcgccgcaggaagccgaaaagccggtgcaggacgaattgcgcctggataccgaagccgagcaggcggagcaggccgagcagcaggagcgcggcgaacgccgtcgccgccgcagccgccgcgatcgtcgccgcgacacgccggaaggcgccgtggcagaagcgggcgcggaagcgccggcagctgacgccgccgaggcggtggttgtcgccgcagtggccgctgaggtggttgccgaagccgcccagccggcggttgagccggaggccaaaccggtagtcgaagccgtgactgagccgcaggtggaggcggttgtggaggccgtggcggttgtcgagccggaagccaagccggtggagccggtagtcgttgccgaacctgcagctgcggtgtttgttgaagccaaggttgacgcggcggcggcgcccgctgttgtggaaccggttgaggcccgagccgagcccgaagccgttccggtggccgagcctgtgtcggaagccgtggtgatggcggcagttgtcgaggaggagccgcaagcggccgagccggtggcggttgctgtcgagccggtcgtcgaagccgagccgatcgtggtggaagccaagccggtggaagccaagcccatggatctgggcggcctggtgatggttgcgaccaagccggttgccgagcattcggcagtgcttgagccggaactgccgcaaggcccgcgtcgccgcgacatggcggctggcatcgatgccgctgcgcaggccccgatggagctggttcaggtggaaacccgcaacaactgatgcggcggatgctggcgcagggcaagccttgcgccagcgatcgccagcagaattgttgacagttatcagaaggaaagctacaattctttcctctgatgttccctgatagctcagtcggtagagcgacggactgttaatccgcaggtcgcaggttcgagccctgctcggggagccaaagaatcaagaaaagcccgcacttccgagtgcgggctttttgcatttcaaccagcggtggccggcgcgctgttgccctggcgcgacggcgccgggtttggatcgagatgcgccagcatgatgtcgcgcaccgcggaggcgggcagcatgccgtccgccaggctgccggcttcggagctgatcagcagcgggccgtcgtcgggagagtccgtcggcctgccgtgcgagcctttcaccagcgagccatccagcgaaaccacctccagcaggctgcgctgtcccagcttgcgcttcaacagcgtccaggcgatgcgcagcttgggcagagccaactgcgggtcgaggaacaactccaccgggtcgtagcctggcttgcggtggatgtcgacggtgcgcgcgaagtccggcgccttggcttcgtccagccaatagtaatagctgaaccagcggtcggcccggctgatggcaaccagctcgcctgagcgcgggtgattgaggccgtacagcttcttgccggcctcgtccagcaccatctccacgccatccagttgttgcagcagtgccttgacctccccgaccagctccggccggcggacatagacatgggcgacttgatggtcggccagcgcgaatgccgccgacgcgccgcaatccagcttgtcttcgccttgttcttccctgacctgcagccagcctgcctgccgcagcgcccgattgatggcgatgtcaccgcgcacctgggtgatgccgtattcggacagcgccaggatgcgcgtgccgtcgcggcgcgcggctgctatcagctctgcgcacagctggtccaccgccgccacttcgcgggcgatctgcggatggtccggccccagcttttgcaggctgtagtccaggtggggcaggtagaccagcgtcagtttcgggtggcggctgcgatacaggtgcagcgcacaatcggcgatccagcggctggagcggatgtcgctggcggggccccagaaatggaacagcggaaaatcgcccagccggtcgcgcaattcttggtgcagttcggcgggcgcgctgtagaaatcggggatcttgcggccatcggccttgtagatcgggcgcggcgtgacgctccattccacgtcggcgtacatgttgtaccaccagaacagctgcgcgcagctgaagtcggcatggcgccggcgcgcctcgtgccatattttctcgccctggatcagcgcgttgttctgtttccagaacaacggctcggccaattcgcgcgagtaccagccattggcgacgcagccgtgctgcctgggcggcgcgccggtgaggaaggtggcttgcgccgggcaggtcagcgcgggggtaacggtggccaagggccgcatgcagccgtcctcggccaactggcgcagcgccggggcgaagcgcagcagtttgggcgtcagtcctacgacattgagcacgatggcgcggggcatggcgcggcctattggtccagggtgtcgacttgcggctgctggccgcgcaacaccgagttgccctgccattgctggcgctggtccacatcgaggctggcttcggcttcggcgatgtccagcttgccgctttgcgcgaagaagcggatgggattgcgccagactatggtttcgatgtcgcgctcggcgatgccggccgcgcggaatgccgcgacggtcttgggcaccttgagcggatcgctgatgccccagtcggcggcgctgttgatgatgatgcgttcgctgccgtattgctgcaccagcgctaccatcctgggttcgctcatcttggtgttggggtagatggagtggccggcccagcagccgctgtccagcaccagtggcagggtttcctcggtgttgtggtcgatcagcacccgctcttcggggatgccgctgtcgcgcaccagggccaggctgcggatggtgccggccttcttgtcgcggtgcggggtgtgcaccagcactggcaattcgtgcttgaccgccagttccaactgcagctggaagtaatgctcctcggccgcggtttcgtcgtcgaagccgatttcccccaccgccaccacgccgtccttgtccagatagcggtccaacagcgcgatcacgccgtcggcgatgtccgggttgttggtttccttggggttgagtcccagcgtgcagaaatggcggatgccgaactggctggcgcgaaaccgctcccagccgagcaaggacaggaaatagtcctcgaaagtgccgatgtgggtgcgcggctgtcccatccagaacgcgggttcgacgatggcgtgtatgccttcgcggcgcatcgcctggtagtcgtcggtggtgcgggagctcatatggatgtggggatcaaacattttcatggcggcttcctttcaggatcaggtatacgtcgtctggtatgtcggcctgggtggcttggcgttcgctggccagatcggccgccatgcggcgcagctgcggggtcagcctgtgtcgcagcccgtggatgcgcgacagcggcgtgcgggtgaatagcgccttcaggaccatctggttgaagttgagctcggggaagaagcgcgccgggtagccgttttcgcaggcgatggcctcgaaacagccctggatgtggctgcggcaggcgtcaatggccaggggtaggtgccgctccggcgccggcagcagcggcagcgcgcgcaacaggctttgctgttcgccggcgtcgccgccgcgatacaggcgcgcgaagcagggatgcgcctgcccgtcgcgtgattctggcagggacagcagcaacagcagccggccgatgtcgccaggccgccaatccagcggcgcgatggcgccggcgcgctccagctccggctgcagttgccggggcagctgggacagcggctgcaggctgcgggcggcggtgctgtaaagccgctgcagcgcggcggcatccggaagcgccgccagcgcggcggggagttgttccagccattgccgcgcagccggcgcggcggggagttcggccgattgccggatgtgcagctggatcaggtttttcagcatggcaggctctccaggttggcgccggttcaggtgccggcgatgcgttgctggaactgggtggtgagcaggaaggcgagcgcgccagccagcgcccaggctgccatgccgtgcgatgccatcagcagcgcgtcggccagcgagatgccggcgatcaggccgccgacggcggcgcggatgtcgcgctggttgcgaaacatcgccagccatacgcagcggcccacccaggcgacaaatagcgccaggcctggcagcagcagccagtttggcggctgcgtcggcaggtacagcagcggcgcggccaggcccagcagcgggagcaggcgttggatgcggccgctttgttcgtgcttggcggcgtaggtgaggccgatcaggtaggcgagcaacgcgccggcgcccagccagaccggcggcggcagctggccgccggtcacggccagcgcggcagcgatgtagaccagcgcgcggcagaggcccatcagcagcggactgaaggcattgcccttgtgatgcaggtcgtacagcaggaccaggccggccagcaacagcccggccagcagcgccggcctgcccatggctgccagtagcagcacgcccgcgcccagcatggcgaagccggccgcgaacaccgcggcggcggaaacctgcccggagggaatgggccgttcgggccgctccagctggtcgatgcggcgatcaaatgcgtcattgaggaacatgccggcggtgtagatcagcgacaatgccagcagcaggatcagcagcgtggggggggagggcggctggccggacagcacggcgccggcggcgacattgctccacaccgtcggcaggttggatacccgacccaatttcagaaaaacgcgccaatcgctcattgcagttgctccttgacccatgacagctcctggcagatcgcgtcatcgagattgccggcgcgaaagccgggaggcagcacgtgccagctgtaggtttccacttccaggtggctggtgaggctttgccggcggtgcctggccagaacctggcgcacgcagtcctgggtgctggagaagtctcccagttgttgcgcccatagcggcacatggaagtggatgcgccattcggcgccctgcgcctgctccagttgggacagggccgccggcagatcgtcgaagcgccgcagcccggcgggggtgcgctggacgacttggtgcaggtaatggtcgtcggcgaacgattgcagctgcgcctggtggcccggctggacatcggccagcttcaggccgacgctcaattgcagtttgaccaaggcgatgccggcggcggccagctggtccaggctggattcgatgtcctcgaactccacggcggcgtggcagcagtccaggcagacgccaagatggcgccgcagcaaggtttccgcatggccgggcggacagtggcataagttggccaggcgcgtcagcgcggacgctgtcagcagatgccgctggaaaaaaaggatggcgtcgcgcgtggtttccagcaggcattccggctcaggctccagcgccaggcggatgcagcggccgctttccatgtgcagatggtgcagagtggcggcatgccgcagcagatggtccgcgatcagcggcaattcttgatcaggctgccgcaaatgggcggcgtacgcgccgggcagcgtgctgatgctgccgtcgatgtcggggggcagcagatggctgagcagccgcgccagcctgtcgctgtactccagccgttccggatggcgccagtcgggcagatagacctggcgcttggcgccggggccgtggaagcggccataggggaaaccgttcagcgtgaacacgtacagctggtggcgcgccaggaactgcaggaattccggcagcaggccggcttgcgtttccaattgccgcgcggccagcgccgacagccgcagcccgacgccgaacggttgcagcggagagacctgggccttgatcgccggcagatgcttgcccagcgccgcgcgggtttcgtcccagctttccgcggggtggatgttggtgcaatagcacaggtggcccagctcgatggccggcgaggctgtcgtggccagcctcatgcgcaggcctcgggcatgccgtgcctgagccagcttatgctgctggccagcagcgatttgtccatctggtggatctctatcccgtgtcccagcctttgcagcagagtgacggtcaattcgccgcccagatgctcgcggaactcgtccaggccggccagaacctgaagctgcccttgggcgtcgcgctgttccagcagcggcgtccacagcgtgaagcccagtttctccagcagcaggcacagctgggcggcggcttgttgcggcagcaacccgctctgcgccgcgtagcaggtgtccaacgccatgcctatcgccaccgcttcgccatggctgagctggtagtggctcatggcttccagcttgtgcgccgcccagtggccgaagtccagtggccgggcgttgccgaactcgaacgggtcgccggcgccggcgatgtgctgcagatgcaattcggcgcagcggcgtatcatccactggcaggcatcgtcatcgccccggcgcagcgcgtcggcgtgttcccgtagccagttgaagaaggcgatgtcgcggatggcggccaccttcaccgcttcggccatgccggaaatgcgcgcgcgcatcggcagggtggcgatgaagtcgtaatcgttgatcaccgcgtaaggcggggcgaaacagccgaggaaattcttgctgccgaaggcgttgacggcggttttgacgccgacgccggagtcgttttgcgacagcacggtggtgggaacgcggatggtgcggatgccgcgatgggcggtggcggcggcgaagccggccatgtccagcagcgcgccgccgccgacgatgacaacgtagctgtggcggtcgatgtgctcgtcatgcagccactgctgcagcgcctccagcatgaccggatggttcttgaccgcctcgccgccgggcagcacgcgcggcgcggcggccaactgcaggcagtcgcggtgatggtcggcgtagcgctggaaatcctgcgcgaggctggggtgatgctgggccacaccctggtcgatgaccaccacgaagcggtgccggatgtgggacgcctcccggcagatggcgtcgcgcagcgtcgggttgtccggctgcagcagcttgcgggtgaaccacacctgatactcgtaggaaacgctgaagcgttggcggatcgagtcgtgcgaaatgccattggttttcgagccgtcgtccagtgcgggcatagggcgctttctttcggaaatgcagggttggcgggggctcagttgtaactcatgccgttttgcacatcgcggtagacaaaactcagtccgatcggcggcttgggctggcccttgtcgtagccaagcagcattgaagggttcatcaggctggccgacagcaccttgaggtcgaacatcaggccgatggccgtgtccatctggccaggctcgccgttgaaggcctggtgcaggctgttgagcaggctgctgtagctgtaggcgaagcgttcgatcagcgtgcgctcctggctgttttccgggtagtcctccggtttgggcgtgggcggcatcggccacacgccgtcctgattgaaaggaatgggcttgccgccgaagcaatagcctttgccgtcgggacagggcgtgatttcgcggccgttggcgatggattcgaatttgtagtagtgggccaggtcctccagtttttccggagcgttcggattctgataggggctggcgctggtgccttcgccctgggtgatgatcacgtctatcgccttcttggcgctgtccacgtcggtgatggggaacagcacctggggcgggaagtagttcagcacttgctgcggcaattggccgaattgcaactggccgctcaactcgtccagcttgtacttgatgctttcgtagtactcgccgatggtgtggaattccggttcctggccttttgcgtaaagtccgatcatttcatgtaccgggatcgggtcggtcggctcttcaattcccatgaaggtcttgcgcgtcaagtcgaggctgaaggcttcgatgccgacgatcaggccgtcggcgatgcccatcggcagcgggcctgggtaattcgggatgaagtccggcgtgttgatgcgcggatggccgccaatggcgatcaggatattggcggagatggtcatgtgcagcatctcttgcatcacgatgccgtggatcagtttgccgatttcgcggttttggcctggtttcagcgacagcatggcggtgagatagggcgggatggtgctgtgctccagttcgatcgccttttgcaggtagaaatgcaattgcgccggcgtggtggcgctgagcaggccctggatgaattttttgtcgatctggaaggcgggtatgcgcttggtcatggcagatcctctacttggccgttttctggcggaaggatgtggaggcggtgggccgcggctggcggatcgcgctttcccgcaactctatctcgacgatttcgggttccggcggcgtggtttccgcctgcttcggcgccatggcgctgagccaggagagcagcatctctctgttggcgtcggacaggtcgcgcgacaccggcatgtagttggggtcggtcggcggcagcgagaaagccagcagcagcgcgtggcgatgggcgcgcaccgattcgtagttgcccagatccaccaggtggcggctcatgatcggatacaggttgccgtattgctgcaggatgggttggatatcccgttcccaggtggggtgcttgggaatggccgtcttgttgaaggctaacaggctgacgaaattccagtattcgcagtacggcccgcccggaacggtggccattttcccggcgtagctgtccggcggcggctggaagccgtagctgagcgcatacagctggccgtcgatatagccgcgcggcgtttcgcccagtggcggcgacgcggagatggtcagcgagcccttgccgtggaagtcggtttccagttgctcgggcacctgcagattggcttcggggaagcccacatgcggggtatccaccggcggggtcagcgaattgttcgacatgccggtgccgcccatcgggttgctgttgggattgccgggcggcaattgccagacatgcagcttggtggccagcggcttgccgaactggctggcatagaaatccacctgctgcggcgtgtcgggattcagccggaacacgtggccgtcggcccgcgcgtactggccgtcgatggcttcgtaagtcagcaccgggtatttgccgctgctttgttgggggcccagcagcagcagcggcgtttgtcccagataggcggcgatgtattgcttgttttccagtgtcgcctggttgtcgctctcgccggccgcgtaacagaaaccctggatgcccgccgtgcgggtgtaccagccttcctgcaggtagtcgacggtgcccaatgggacaaactctgacgatttcacgagggatgggatgtggtcggtgtcgtcatccagtcgcgccagcgccagcgtcagggtgccgatattgtgcaactggccggtggcgtcggtgatcggcagggccaggccgaaatccgcatagagggtttgctgctcgggacggttgacgcattgaaaaccgtacacgcctcccagcggctgggtcgggaagggggcgccattgggcgtggtgggttgcaagggggtggtcaggtggcggcccagcacgaagtgcttgggctcgtcgcggtggtaggggccgatgctgccgctgaccaggcccatggtgaagcgttggctggtgttgtcgcgggtgtagccgtacaggttgaagttgatcgacaggcaaccttgttcgctggcttccttcaaggccagcagcacggcggagtcggcgcagccgctccagtcgacgtcgtgcaggatggactggtagttggcggccatcggctgctcccaacggctttgtgcgttgagctggcgttgccagaggttcatcaggggcaccggcagcaggtcgccgcagaagagcgcgcgctcggtcgggctggccagccgcacttgcacgccccatagttgcgagacgtactgcatctgcgggtcgaggtcgactatcttgcccggcggctgctggtcggcgttctccacgcgcagaccgatcaccggatcctcctccggacaggtgagcagccggtcgcccagctgggcgccggtgatcttgcattctatgaaacggaaaatgccggtgccttccggattccagtagccttcggcgccttccgggccgccatccgggtagtgctgacgctgatattcggggcggaaggcttcgttgtcgtagtagcggacgtcgttgttgacggtggaggggtctgcctggaatacaccggtgaaattgatgcgcggcgcgtcgagatagctcatgtcggctcctgggagggcactgcggttggctacggcctctagccagaataggagccgcaaatcatgacatgcaaatttgctaggctgtactttggtgcaggttgaattgggatagcccatagtgtaagcggtgggtggactgtttgatgtcattggtatttttgttgcggcgggaaccaagatcggcggattagccctaagatgtcatccctttgactaccacggtgccgggcgggcaagcccggcaggtttgcatacgaatggcttttctcgaatccctgaatcaatccctgttcctgctgatcaacgccacccccgaaacctccccgctggccatcaaggcggccaccctcgtcgccaaggacgtgatgctgctgctgccggtgttcctggcggccatctggctgtggggccggcccgcgctgcgcgataccgtgttgaaatcctgcctgctgacgctggtcgccctgctgggcaactggttgatcggcctggcctggccgcatccgcgcccgttcgcgatgccgatcggcaataccttcctgctgcacgacgccacgccgtcctttcccagcaatcacggcaccatcttcgccgtgatggccttatgctggtgtttcagcccggcgcgcggctggggctggctgctgagcctggccggcatcgccgtcgcctgggcgcgggtatttctcggcgtgcacttcccgctcgacatgctgggcgccctgctggtgtccatcttctggtacgctagcctgtcgccgttgtggtcgcgccgcgggacggccctgaccgaaacgctggaatccttgtaccgccagttgttggccaaaccgatcgccgccggcctgatcaggcgctaagcgcgcccgtcgcttccggcggccaatgatgtcgccgggagctttcgtgccgcaatcttcctctctgctgtccgtcgccggccgtgcggctatcccgcgcggcgtctgggtgctgggctgcgtcagcctgctgatggacgtgtcgtccgagctggcccatagcctgctgccgctgtttctggccggcaccctgggcgtgcccgtgctggccatcggcctgatcgagggcgtggccgaggccaccgcgctgatctgcaaggtgttctccggcgcgctcagcgactggctgggcaaacgcaagccgctggtcttgctgggctacggcctggcggctttctccaagccgcttttccctcttgccgactccgcctccaccgtgctgttcgcgcgctttgtcgaccgcgtcggcaagggcgtgcgcggcgcgccgcgcgacgcgctgatcgccgacatcacgccgccggccatccgcggcgcggccttcggcctgcgccagagcatggacaccgtcggcgcggtgctgggcccgctgctggcgatcgcgctgatgtttgtttaccgcgacgacatccgcagcgcgctgtggtggtcgttgccgccggctttgctggcggtggccgccatttggctgtgggtgcgggagccggcggaacatggcgagaaaagagagcgcgcgcccatgctcaaccgggcggcgctgtcgcgattttccgcaggtttctggggcataaccgcgctgggcgcggtgttcacgctggcgcgcttcagcgaggccttcctggtgctgcgcggcgcccagttgggcttgccgctggcttgggcgccgctggtgatggtggcgatgtcggccagctacgcgctcagcgcttaccccttgggctggctgtcggaccgcgtcagccgcgcgcggctgctgcagttgtcgctgctgttgctgatcgcggcggacctggctttgggcgcggcctcgggtccggcgctgttgctggccggcgcgctgttgtggggcctgcatctgggctgcagccagggtttgctgtcggcgctggtggcgcagaccgcgccggcgggcctggccggatcggcattcggcctgttcaatctggtctgcggcctggcgaccttgctggccagcgtggtggccggcgccttgtggcaagaatggggtgcggcggcgactttccatggcggcgcggtattcgcggcggcggcgtggctgcttggcctggttttgcgtccgctgcgacagttctgacagatggtgtcttgactgtgcgcagattgcctgttttttaagcacacaggctggcgagttggtggtaaagtaaatgtaaagttatttgcttatatcaatttgttatgtgtcggcggagtgagcatgtctgaacgtgaagttaggttgtggccggagttcgtcaaggccctgaaacaggaagtggtgccggccctgggctgtaccgagccgatttcgctggcgctggccgccgcgctggcgacgcgcgagctgggcaagccgccggagcgcatcgacgcctgggtatcggccaacctgatgaagaacggcatgggcgtgactgtgcccggcaccggcaccgtcggcctgcctatcgccgccgcggtcggcgcgctgggcggcgacccggacggcaagctggaagtgttgaagagcctgaccgtcgagcaggtggccgccggcaagcagatgctggccgacggcaaagtgaagctgggcgtggcggcggtgcccaacatcctgtacgccgaagcctgtgtctggcacggcgacgagtgcgcccgcgtcgccatcgccgacgcccacaccaatgtgatcaggatcgagcgcaacggcgaggtgaagctgaagcgcgaagccgccgacgccaagccggtggaaagctacgagctgggcgacgccaccgcgcgcgacgtctatgagttcgcgctacgcgcgccgctggacagcatcgccttcatccacgacgcggcggtgctgaacagcgcgctggccgacgaaggcatgagcggcaagtacggcctgcacatcggcgccacgctgcagcggcagatcgaggccgggctgctgtcggaaggcctgctgtccaacatcctcacccgcaccaccgccgcgtccgacgcgcggatgggcggcgccacgctgccggcgatgagcaattccggctccggcaaccagggcatcgccgcgacgatgccggtggtggtggtggccgagcatgtcaaggcagaccaagaaacgctgatccgcgcgctggcgctgtcgcacctgatcgccgtttacatccacacccgcttgcccaagctgtcggcgttgtgcgcggtcaccaccgcgtctatgggcgcggcggccggcatggccctgctgctgaacggcggttatccggcggtcagcatggcgatttccagcatgatcggcgacctggccggcatgatctgcgacggcgcgtccaacagctgcgcgatgaaggtctccacctcggccggttccggcttcaaggctgtgctgatggcgctggacggcacccgcgtcaccggcaacgagggcatcgtcgcccatgatgtcgacgtatccatcgccaacctgggcaagctggctacccagggcatggcgcagactgacacccagatcctgcagatcatgatggacaagcgctgagcgcggttcaccacgatgcgacaagcccggcagcgccgggcttttttcttgccgcgcggcgggtttcaacgggaagccaggtattgcgccggcggcgcgcccagcgcgcggcggaacatggcgatgaagttgctgggcgaggcgtagcccagcgcgtccgacacctgggcgacggttttgcccgacgccagctgctccatcgcctataccagttgcgcttgttgccgccagcgcgaaaagctcatgccggtgtcggcttggatcagccggcgcaagctgcggccggacagcgcgccgaggctggcccattcatcggtggaacggtcggcggcgggggcggccaggatggcggcggcgatgcggcgcagccgcgggtcggccggcatcggcaggtgcagttcctgccgcggcgcctggcggatttcgtcgacgatgacgtcgatgatgcgctgctgctccggcgatggcggagcggcaggatgccagcaggcggccagccgcaccagcgcctgcagcaacggcaggacggccagacatatccggcggcgctggcggtggcggcggacggcctgcattcggccttgcgccggcaatggctgccgctggcggaaccgccggcgaccggcgcgctgaatctgtacggcaaagcgcggatggcttgcgccgatgatttcgacgccgatctgctgcgcgggccgaccatcgttttcgccgacggctgcacgctggtggtcgagccgatgcgctttcgcgcgccaatgccggcgtgccggccgagtccggtcgacgattatatctactgggcgctgttcgggcgggaagccagcctaggcggccgtctgccgccggacgagggcgcggcggcgttgcgggagcgtgtcagagcggcggcgcgcggctggcatcccagcttgcgcgccttgctggagcgcaccgacgcgacagccatcatcgggcgggaagtgcggatggcagagcgcgtgccggcttggccgtccggccggctgacggtgctgggcgacgccatccacgcgatgagtccggccggcggcgtcggcgccaacaccgcgctggccgacgccgccatgctggcgcaatgcctggccgaaggcgatatcgggcgggcggtagtccgctacgaagccgacatgcgccagcgcgccgagcgagcgctggcgctgacgcgggccggcgccgaacggctgctgcggcgcgcctgagccgcgggttggcttattcctgcaccgccgggctcagcgcctggcgcacgctcttctcgcccagcgccggcgcgcacagttcgatgaagcggtaggcgtagctgcgcaggtaatggccgcggcggatggcgatgcggctggtctgctggccgaacagcggctcgccgtccaccaccttgacgccgtggtcgcgctgcgggtccaccgccatcgaggcgacgatgccgacgcccagctccagttcgacataggtcttgatcacgtcggcgtccagcgccgccatcacgatgtcgggcgcgaggccggcttcggcgaaggcattgtcgatgcgggcgcggccggtgaaaccgtggtggtaggtgacgatagggtattcggccagcgtctccagcgtcagcgcctgccggtgcagcgggtgctcgggcggcgcgatcacgcagtggttccagctgtagtaggggaaggacaccagttccggcacctcggtcaccgcctcggtggcgatgccgatgtccgcttcgccggccagcagcagccgcaccagctcgtccgggctggcctggtgcagcaccaggtgcacgcgcgggaaggcgcgcttgaaggcggtcaccacctgcggcagcgcgtagcgcgcctgggtgtgggtggtggcgatggtcagctggccttcgtcgcgcaggctgaactgctcggccagccgcttgatgttgccggcgtccagcagcatgcgctcgacgatggtcagcagttccttgccggggtcggtcaggccgaggaagcgcttgcccttgcggatgaacagctccacgcccagttcgtcctccaggtccttgatgtgcttgctgacgccggactgcgaagtgaacagcgcgttggctacctcggtcaggttgaagccctggcgcacggtttcgcggatgatgcgcagttgctggaagttcatgcttcacctgcctgtgtcggggtggcgaaaaccctggcgccgcgcgcctgcagccgcaccggctgcccgacggcgatttccgccagcagcgggtcgtcggccggcagctcggcgtcgaactgctggccggtcagctcgccgcggccctccagctcgatccgcgacagcgcacccagcgtcaggatgcgttgcacctcggccggcaagccggcgccgtccgcgccgggcaggatggccaattcgtgcgggcgcacgaaagcctggaccgcctgtccgggcgccagctggtgctcggcctccagcagcgatgcgcccaccgcgatgccgccggcttggctgcggccggcgaagcggttggcgctgccgagaaagccatagacgaaggcgctggccggcgcgcggtacacctcgtccggcgcgccgatctgctccaccttgccgtggttcatcaataccacccggtcagccacttccagcgcctcttcctgatcgtgggtgacgaagatggaggtgatgtgcaattcatcgtgcagcttgcgcagccagcggcgcagctccttgcgcaccttggcgtccagcgcgccgaacggctcgtccagcagcagcacgcgcggctccaccgccagcgcgcgggccagggcgatgcgctggcgctggccgccggacagctgggcggggaaacggtcggccagccaatccagctgcaccagctccagcagctcatgcaccttgcgggcgatgtcggcttcggacgggcgctcgcgccgcggcttcatcctcaggccgaaggcgacgttgtcgaacacgctcatgtggcggaacagcgcgtagtgctggaacacgaagcccacctggcgttcgcgcacatgggtggcggaggcgtcggcgccgtccagcaacacctggccggcgtcggcctgctccaggccggcgatgatgcgcagcagcgtggttttgccgcagccggacgggcccagcagcgccaccagctcgccgccggggaagtgcaggctgacatcgtccagcgcggtgaaggcgccgaaggccttgcggatatggtttacctgtatgctcatctcagttttccttgacgctgcgccattccacccagcttttcagcgccagcgtgatcagggccagcatggccagcaaggacgccacggcgaaggcggcggcgaagttgtattcgttgtacagaatttccacgtgcagcggcagggtgttggtttcgccgcggatgtggccggacaccaccgacaccgcgccgaactcgcccatcgcgcgggcattgctcagaatgatgccgtatagcagcgcccagcgcacattcggcagggtgacatgccacagcacctgccagccgcgcgcacccagcaccaccgcggcttcctcttcctcgcggccttgcgcttccagcagcgggatcagttcgcgggcgacgaagggcacggtgacgaacagcgtggccagcacgatgccgggcaccgagaagatcaccttcagcccgtattcggccagccagcttcccagccagccgtggttgccgaacaccaggacgaaaaccaggccggccaccaccggcgacaccgagaacggcaggtcgatcagcgtgatcagccattgtttgccgcggaagtcgaagcgggtgaccgcccaggccgcggccacgccgaacaccaggttgagcggcaccgctatcaatgccgccagcagggtgaggcgcaccgccgacagggcgtcgggctcggccagcgcggtcaggtaggtgctccagcctttggacagcgcctcggcgaacaccacgaacaacggcagcagcaggaagacggcgaagaagcccagcgccagcgtcaggatcacgtatttgacggcgcgcgattcgcgggtggcggcgcgggactccaactgcgcggccttgtcggacgccgcgcgcggatgcgggatggcggcgctcatcggctgcctcccgcgcggccatggcggcgcgcgctccagaactgcaggccgttgatcgccagcagcagcaggaaggacgccgccagcatcaccgaggcgatggcggtggcgccggcgtagtcgaactgctccagcttgctgatgatcatcagtggcgtgatttccgacaccatggggatgttgccggcgatgaagatcaccgagccgtattcgccgaccgcgcgggcgaaggccagcgcgaagccggtgagcagcgccggctgcagcgccggcaggatcacgtggcggaacacttgccagcggcgcgcgcccaggcaggcggcggcttcttccagttcggtctccaggtcttccagcaccggctgcacggtgcgcaccacgaagggcaggccgatgaagaccagcgccaccagcacgcccagcgggccgaaggccaccttgacgcccagcggctccaggtattgccccagccagccgttgccggcgtacagcgcggtcagcgcgatgccggccactgcggtgggcagcgcgaacggcaagtccaccagcgcgtcgaccagccgcttgccgggaaagcggtagcgcgccagcgaccaggccagcagcaggccgaacacgctgttgacggcggcggccagcaaggccatgccgaagctcagccggtaggacgccagcacccggggggcggtggccgcctgccagaagctgtcccagggctggctgccggcgcgcaggatgacggcggaaagcggaatcagcaccagcagcgacaggtagctcaacgtgaagcccagcgacaggccgaagccgggcaaaacgcgcggcggccgggcggcgggaagaagggcgggactggctggcatggcggattccggttcatataaccggatgaacgatatcttcgccagtcttattctgaaaataagtatttattcaatgcttattcaatattatgcaaagaggagcggcggccaaacaaaaccgcccggcgcgggcggcgggcggttgcggaagagcgcgcggtttcagcgggcgatgatctggtcgaacacgccgccgtcggcgaagtggaccttctgcgccttctgccagccgccgaaggtctggtctatggtgaacagcttcaccttgctgaactggccggcgtacttggccgccacctgcgggtcgcgggggcggtagtagtgtttggcggccaggttctggccttccgggctgtacaggtatttcaggtaggcttccgccgccttgcgggtgccgcgcttgtccaccaccttgtccaccacgctgaccggcggctcggccaggatggagagggatggggtgacgatgtcgaatttgtccgggccaagctcgcgggtggcgagataggcctcgttttcccacgacagcagcacgtcgccgatgccgcgctgggtgaaggtgatcagcgagccgcgcgcgccggagtccagcaccttgacgttgccgtacagtttcttgacgaagtccttggccttggcgtcgttgccgcccggttgcttcagcgcgtagccccaggccgccaggtagttccagcgcgcgccgccgccggttttcgggttcggcgtcaccacttccacgccgggcttcaccaagtcgttccagtccttgatgcgcttgggattgcccttgcgcaccaggaacacgatggtggacgaatacggcgacgcgttgttgggcagccgctgctgccagttgggggcgatggacttggcctggctggagatttcgtcgatgtcgtaggccagcgccagcgtcaccacgtccgcgtccagcccgtctatcaccgagcgcgcctgcttgccggagccgccgtgcgactgcttgatggtgacggtttcgccggtcttggccttccagtacttggcgaacgaggcgttgaattcctggtacagctcgcgcgtcggatcgtaggagacgttgagcagggtgacgtcggcaaaagcggaggcgctgccggcgaacagcagggcaagggcgagttggtgcaaggggcgcaggcgcatggcggttcctgtatggactttttgaatgatcgccacactgtggggccgggccgggcgggcgggaaccaagaaaatctgcaatggatatgagaattccagaaaaggcgggcatttctgtaaagctgatagccttatcaggaaacaatatattccagcgtcaagtccgggcctatattagcgccagtccaactcatccgggtccggccatgaaacgattcaagcccgccaagcagcttcccccaggtttttcccccgccgtcctcgctgcctgccagcagttcttgcagcaggagggggtggaggccaggctgcagtggaacgagcaggaagtgttcgccagcttcgacggctggtggttgagcagcagtttctttcctcaggcgcgcctgcgcgacgatcgctgtcaattgctgcaatatgccgccaggctgcgtattttcggccagtttggccaggctttgccggccaattggctgtttgcgatgaattacgcggaaagcaaggcggtggccttgctcaagctgatccgcaccctgcacctggtcaaccatctgggccgcaacggccgccacctgccgctgcgcatagacgtggacccgcgcatctgccacgcctacagcgaccgcatcgtcgatttcaccgcgcgcctgctggaggtgctggagtttcccgcccgccaggcgccgctgctgctgtttctcaatgacaagaccagcgagttgggcttgtccttgctgcggcgctaccgccagctgggccatcgggtgggcctgggcgatttcggcgaatgcggcgaggacctgctgcggttgtggcggctggagccggatttcctgtcgctggcgccgcgcttcatgagccgggccatcatgtatccgcaagtgcgcgaccgcctgctgcaactagtgccgcagctggtggagcagggctacgcgctggcggtggaggacatcgtctgtcagaacatgctgggcctggcgcagcagatgggcgccgagcatctgtccggcccgctgctgtcggaacggctgcggcggcagaaagccgcgcagctgatggatttgaatgtcattaacgcttagactgtcgcgattccaaaccaatttcacggcgccctggctgggcggcgtgaacctagggggcaatcgtggggaagtcattggcaggtttttttgccgcggcgtgcttgtccggctgcgtgatcggcaacaccgacggctaccgcgacgcggcgcaattgcaaaaaacggcagatcaggcgttgaagacgtgcggcgcgggcaaggtcaagtcggtcagcgctggcagcttcgcctgcgtggccgctggcgagcagaactagcatggcgggcgcgactgacagccgcgtggcggtgcgtttgttgaacgccgccgatgccgaagcctaccgcgcggtgcgcatcgcggcggccactcacgatccggcggccatccatgccgacgcggctgaaatcgccgctttgtccgatagcgagatcgccggccagatcacggctggcgacacgcagcgggcggtgggcgctttcatcggcggcgagctggccggcgtcgccgccctgcggcgcgacggccgcgccaagatccgccaccgcgccacggtgcagggcgtgttcaccctgccggcgcatcgcggccagggcgtcgcgcgcgcgttgctgcaggcgttgctggacgaggcggcgacgctgccggggctgctgtcgctggagctggcggtgcatgcggaaaacgcgccggccaaggccttgtaccaggcgttcggcttccgccgcgtgggcctgattcccggcgcggtcatgctcgatggccgctgtctggacgaagtgctgatgcagcgtccgctggttttctcatcgtccgccgccgcgccggcttccattccgaaccgcgatgattacgccttgatcgaggccgcgccggatgtcgacacctatcgccgcctgcgcgccgagtccggcctcagccccaagaccgaggaagccgcccggctcggcctggccggcaccgcgtatgcggtgcaagtgcggtgtggcgaggaggtggttggcatgggccggctgataggcgacggcggcagcttctaccaagtggtggacatcgcggtgctgccggcgcatcaggggcgggggctgggcaagcgcatcatggcggccatccgcggccacatcgaccgcgaattgccggtcagcgcctacatcagcctgatcgccgacggcgacgccaagcatttgtatgcgcagttcgggtttgagccgaccgcgccgcgttcggaaggcatggcgctgttcaagcgctgaccccgccgcctgcgggcggcattgttctttgggaaaggccgattcgatgacgcaatcgaagtgacgccggcgatgttcgacgcgatggaggcgcagttcgagccggccaccgcagacgagttgaaccaggctgcggcggtcgccacctcttagtcggcagaccgcatgccctggtagcccaggcgcgccgccgctcggatccagccttgcagcgccgcgtcgacgccgggcgcggccagtcccagcactctttgccgcagcggctcggcaatggccatcgccagcagcagctcggcgcagctcgccggatgatccacgcgcagctggccgcggcgctggcgttcggccagccagtcggccagcagcgccgcgctgcggcggatgccgtgttgagcgtacgattccagcgcctgctcgcggccggggaagtcgttgctcagcagtttgaacatgcctaccgcctccgccgacagcacccgttcggcgatggccagcagcagcgcttccagcgcatgcggcaaatcctttccctcgtcctccggcgtttccaccgcgcgggccagtccggcagtccagtcgtcgacgatggccgccagcagttgttcccgattgtcggcgaaacggtacaccgtctttttggccaccccggcgcgtttggccaccgcctctatgctcaatgccggatagccatcgttcagcagcagcgcggtcgcggcctgcaatacctgatggcgcagcgtctctgcggacaaggcggggcggccgcgcggacgggcgggggcgcgggggggggaatcaagcggacttgacatgggttctcatgttgtttgaatatggaaacgttaaccgtttcttaattgatcgcgcattcgcgcggccagaacggtcaaacagcgaggagtgtactgtgaacgcccagaatcggatatccagtcatgacgaactactgtcatcgcggccgctgcctttggaaaccggcatccgccggctggacgacggccggctgctggtggcggtgagaaccgagctgccgggctgcgccggcaggatgctggagtggtggttcaagtttttcgagaccacccagcatattcgctggtggcatccgcacgaccatctccggatgcatggctgggacgggcgctggaaacgaggcgagtcctacatcggcgcctgcgtgcgcgcggaagagtcgctgggcgactttccgccggtcacggcgacgctgaagtttcacgagtcggaagattttttctcgcccgacgcgctggcgcaggccaggcgcgagcagagggtgtccggagtggtgtgcgcccgcatcgccttcggcgacgagccccgtttggcggccgatggcgacccgctggacggcgagatgatccacctggcgcgcgacaagccgcagggcgcggtgctgcgcagccgcttcgtgctgggcggagaagcgccggtgccggacgagttgggcctggggctgatgcagcattgctacaacgagttcagcagcctggcgcgtttcctgccttcgctgtactacggcgagcacgccaacggcgagaaggggccgctggcgtggtgaagaggcgttctgccttgccgctgcggctcgctaatccaagtgcgatatgggcgtggctggttttttctattcttgtggccatccggcatgccacggcgtaaccgtgtttagggtgacgggtgttgctcagatgccggcaagtggtttttttttggatggtttgctctggcggcagaacatagaatatccccaggcgattttatagccggtttttgaataaagagaagaaaccgaatggccgtcgcatgcaggaatgccgatggccatttttatttggataggcgtgaaatggaatcgaaaaaattagtgtgcggcgtgatggcgctggttatcgcggcgtcctcgatgagcggctgctcaagcgcgaagaaaccgcgcaaaaataaataccttgcgcaagccagcagcgcggctgcaatcaagaatatcgacatctactaccataaagcggattacggcgtaatggacctgggcggttcgagtggattgcaagtgggaggtttgttcggcgtagtaggcttgctggcgtctttgggagccgaggcagccagcagggcgacggcgaaggacagaaccgtcgcgcgcagcgaggagttttccaaactgatgaacagtttggatggcgataacgatatcgatttggcgcaggcgaaaaaactggcggacatgctcacagcctccgggcgcaccgtgaggctggtggagatcaagcggccgcaggccgaaagattgttgctcgaccaaacgccgaatctgccggatagcgatgagaacgccgtgttggtgttgcggacgactttgggctatggagcggagtccgccaccgcctcatacaagtcgatagtggtgaccgagtatgtgttgcagaagataaacggcgaagtggtgcatcgtgggaagcaaacgattcacgacgatggccagacttatatgacgttttcgggtttgaaggaggcctacgtggaaacccatcaggcgctgggaaaagatgcgcaggcgatcgccgacagaatctttgccgcggtggtgaagtaaagcgtgaagaagccggcccgcggccggcttccatccctgggttctagcattggctcacgatgatggcggggcgccgaggcgggctaggcatggccgccatgccggatttgcgcatgcctcagccatgtgagggatcagaatactcttaggccgccgttccacacctttcgcaccagcggcacgtcgccgcgcacggtcatcgccaccaggtcggcgcgctggccgacggcgatgtcgccgcgatcgttcaaacctaccgagcgcgccgggttgaggctgacggtggcgacggcgcgcggcaggccccagcctgcttgcgagtgcagcagccaggcgccgtgcagcaggctggtcggcacgtagtcggacgacaggatatccagcaggccggcccgcgccagctccaacgccgccacattgccggagtgggagccgccgcgcaccacattgggcgcgcccatcaccgtttgcagtccatgcgcgcgggcggcttgggccgcttccaatgtggtgggaaattccgagatcgccacgccgtcgcgcagcgcttcgtctatgtgggcggcgtcggtgtcgtcatggctggccagcgcgatgccgcgcgcctttgccatttccaccaccgcctgcttgtggcggctggcgaactcggcctgcttggccttgcgctcttccacggcggcgaggaaggtgtcctcgttccagcctacttttttcttgccgtagtacttcttgtattgttccaggtcgcggtactggcgctggcccggcgtgtggtccatcaccgacaccagcttcaccgccggatgggcgatcagcggttccagttcggccagcaggcccggataggccagctcgcagcgcaagtggaagaagtgctcggcccgcagcgcgccttcgtccatgccctggttgatggcggcgaaggcgctgtgcagcgtgtccagccgcacgctgtcgccttccagatcgcccaccgacagcgcgtccagcaccgtggtgatgccggcggccacgcattgggcgtcgtgggtgatgacggctggcagggtaggccacagcacgccgttgcgcggcatcaggtgtttttccagattgtcggtgtggatctccaccaagccaggcagcagcagcgcgccggccaggtcttcgccttcgggcagcggttgttcgtggatggcggcgatcaaaccgttctcgatctccagcgctccgttttcgatcacgcggtcggccagcacgatgcgggcgtggttcagtacttgtttcatgctgcggtttccgtttgttgcgccagcggtacctggaacacgcggctggcgatggcgtcgcgggtgggggcgtcgtggaagatgccgaccaaggccgcgccgcgggccagcgcctcgcgcatcaattgtacgaccacgtcgcggttggcggcgtcgagggatgccgtcggctcgtccagcagcagtatcggccgcggcgcgatcatgccgcgcgcgatgttgacgcgctgctgctcgccgccggagaaggtggctggcggcaggctccacaagcgctctgcgatgttcagccgcgccagccattcgccggccgccagccgcgcctcggcgtcggcggcgccccattcgcgcagcggctcggcgacgatgtccagcgccgatacccgcgggatcacccgcaaaaactggctgacatagcccaaggtgtggtggcgcacggcggcgatctcatgtggcagcgcgcgggccatgtcgacccatgcgccctggtggaacacgccgatgcggccgccatcgaccagatagttggcgtacagcgccttcaagagcgtgcttttgccggcgccggacgggccggcaagcgccacgcattcgccggcggccgcttgcagcgaaacgtcggtcagcaccggcagccgcagcccgccttgctggtgcagcgtgaaggtcttgctcaggttttgcgcgtctatcaatagattcatgatttcaggcctgcaggatggaagacaccagcaactggctgtacgggtgctgcgggtcgtcgagtatctggtcggtcaggccggcttccaccacgcgccccttttgcatcaccagcgtgcgctgggccaagaggcgcgccacgcccagatcgtgcgtcaccatgatcacggcgatgccggcatcgcgcaccaggcggcgggtcaggtcgaggaagcgcgcctgcaccgacacgtccaggccgccggtgggctcgtccatgaacaccagccgcggctgggtcaccagattgcgggcgatctgcagccgctgctgcatgccgccggagaaggccgacggcttgtcatccagccgcgcgcggtctatctccactttttccagccagtcgccggcggtttgccgcagccggccgtagtggcgctggcccagcgccatcagccgctcgctgacattggcgccggcggagacgcccatgcgcaggccgtcgcgggcgtgctgggtgacgaagccccattcgctgcgcgccaggcggcggcgctcggcctcgggcaggcagaccagttcgtgttgggcgccgtcgcggtcggcgaagcgcacgctgccggcgtcggcggccaggcggccggccaacgtggacagcagcgtcgatttgccggagccggattcgccgacgatgcacagcacctcgcccggatacagctcgaaattgacatcgaagcagccctggccgttgccgtagtccttgctcagcccgctcacggtaagaatgggcgccatcatgcttgtgtctcccgctggcagtagtcggtatcggagcagacgaatagccggctgccggcatcgtcggtgacgatttcgtccaagtagctgtcatgcgaaccgcacagcgcgcagccttgctgccagctttgggccgtaaacggatggtcgtcgaaggccaggctttccaccttggtgtagggcggaatcgcgtacaggcgcttttcgcggccggcgccgaatagcagcagcgccgggctcctgtccagcttggggttgtcgaacttcgggatcggcgacggcgaggccaggtagcggccattcaccatcaccgggtagtcgtagctggtggcgatgtggccgaagcgggcgatgtcctcgtacagcttgacgtgcatcaggccgtattcctggtgcgcgtgcagcttgcgggtttccacctcgctggcctccagcgtgcgcagcggctccggctccggtacctggaagatcatgatctggccgggcttaagcggcgtttccgggatgcggtggcgggtctggatcagcgtcgcgtcgcgagtggccgtagtggtggccacgccggccacgcggccgaagaagcggcggatgttgaccgcgttggtggtgtcgtcggcgccctggtctatcaccttgagcacgtcgtcgcggccgatcacgctggccgtcacctggatgccgccggtgccccagccgtagggcagcggcatttcgcggctgccgaacggcacctggtagccgggtatcgccaccgccttgagcaggccgcggcgcagcatacgcttggtgttctcgtcgaggaagccgaagttgtagcggtcgttgcgggcgtcagtcatcggccttctcctgatcggcggcggcgcgcagctggcggatcagcgccagctcggcctggaagtccacgtaatgcggcagcttcaggtgctggacgaagccggaggcttcgacattgtcgctgtgatacagcacgaactccggctgctgggctggcgcgtgggcggtttcgcccaactcttccgcgcgcaggctgcggtctaccagcgccatcgccatcgccttgcgttcggcctcgccgaagctcaagccgtagccgcgagtgaattgcggcggcgcgctcttgctgccggcgaactggttgatcatctggcattcggtcagcgtgatttcgccgatgtcgatctcgaagcccagctcctccgggcaaaccatcacgctgacttcgcccatgcggatttcgccggcgaaggggtggctctcggcgtagccgcgttgggtggagtaggcgaggcccaatagccagccttcgtcgccgcgggccaggttctgcagccgcgccggacggccggcggggaacatcagcggctcgcgggtcaggtccaccggctccgggtcgccgtcggccggcaggtcggtttcgatcaggccctcgctgtccagcagctgcagcacgctgggcagcgcgtccggcagcggcgtggcggcctgttccagttcgactttttgcgaggtttccatcaggccgaagtccagcaggcgctgggtgtagtcggcggtggggccgaggatctgcccgcccggcacgtccttgaaggtgccggacacgcggcggcgcacccgcatcgcggcggtgttgagcggcagcgtctggccgaagcgcggcagcgtggtgcggaaggcgcgcagcaggaacaccgcctcgatgctgtcgccgctggcctgcttcaacgccaacgcggccaattcctcatcgtacaacgagccttcctgcatcacgcgggccacggccaggcgcagctgttggcggatttgggcgatgctcagctccggcgcggcctcgtcgccgcggcgcgcggcggccagcaagtcccaagagcgggcgatggcggtttccccgccttttacggctacgtacatcgtgtcaaccctcgcggatgcgggcgctgcgcggcaggccggcgatgtgggtgtcggaaatcagcatggcgtccacgcccagcgggaagcgggcatggttgcgttgccattcggcccagaagccggatggcaaaccggcggcgccgaaacggcgcggcatggcgaagccggggccgctgccttccacctgatcctcagcgaagctggccacctcgatcagcagcgtggcggagcggtccgggtattcggcgctgccggccttcaggctcatcagatccggcagcggcatgccggcggcgatgacgatgaagtccgcctgttccggcagatcggtcatgcgcatgccggtgtgaaagcgcaggctggagacggtttcgtccggcagcgccggcagccagacgctcacgtcctggtctgccagcgtataaagcaaagcggcgatgccggcctggagaccgggcagggccggcggcaacaccggcagcgcgcgcggtagcagcggctccgccatcgcgctaagcaatatgcggaaagtttgctgggcgtcatccaccggctgggcaaaagcggtcaacattttcattccccccgcaccatggtgaaaaactccaccttgctggcggcggcctcgcgcgaacgggcggcgcggcgttcggccagctcggcctccagcggggcgatccaggctgccatcagttccgcgtggcgggccggattctgcagcagcgcgtcggcctgggcgatcagctcggcatggcggccgtcgccgccgcgcacccagccgtggccgatatggccgtctatctcgcagctggcgcggctgacgctgatctcgccgaggttgaagcgggcgccgctgccgccgctgcggccttgcagcatcatcaggccggtttcggcgcggcgcagccagcgcggcgcggcgggcagggccggcggcagcagggcctgcagccgttccatcgggctgttggccagcgcgcccagccagcgctgtcgggtggaggtgtccatcgtgtgcctcatggttcaataaagattcatataaacgtatagacgtatgcatgataatggcgagcagcgatggattaacagcatgcggcgatgaaggttttgtgacgtttttacggcgcgactagacctttgccgtggcgagacaaagaggagcgtggcaatgatagagagaggttccggcgtcgccgtctggcggcagatagaagacagcctggcggcgcagatcgccagcggcgccttgcaggcgggcgcgcagctgccgaccgagctgcaattggccgagcgtttcgccgtcaaccgccacaccatacgccgcgcggtggctaccttggtggagcgcggcctgctgcgggtggagcaggggcgcggcactttcgtgcaggataatgcgatcgactacgccatcagcaagcgcacccgcttcacgcagaacatggcgcggcagaacctcagttccgacatcgacatcctgctaagcgacactgtaccggccaatgccgagctggccggcctgctggaagtcgcggtcggcgacgaggtgttccgcatcaagaccctcagccgggtggaggcgagggtggtggactgcgcgacgctgtttttccccgccgcccgtttcgccggcctgccgcaggtgtaccagcgccagcgctcggtgacgcgtgcgttgcgggagttcggcatagacgactacacccgccgcttcacccgcgtcaccgcgcggctgccggacgcggagacggtggattatctgggcattcccaagaaccgcccggtgctgcatgtgaagtcgctgaacgtggacctggacggcaggccggtgcaatacggcatcacctgcttcaatggcgacctggtgcaactggtgatggaggacgactgatgcgttgcgcgctgtattacgcgcccaggccggacagcggcttgtggcgagccggcagcctctggctgggccgggacgcggccagcggccagagcctggcgcagccggcgctggatggggttgacccggccacgctggccgaccttaccgcggcagccgcccgctacggctggcacgccaccttgaaggcgccgttcgagctggcgcccagcatggatgcggccggcctgctggcggccgccgcgcggctggcttctggtttcgagcctttcgcgctgacgctgcgggtggagtggctggacgattttctggccttgcgccccgcggcggcgtcggccgagctggaagagctggccgcggcatgcacgacggcgatggcgccctgggccgacccaggccaggccctgaagccccgtcccgggctggacgcccgccagcaaagcctgtatcggcgctggggctatcctttcgtgttcgagcagtttcgtttccacatgaccctcagcgccgggctggcgcgggaatcggcgctggccgccagcctggagcggggcgcgcgccggcatttcgccgggctggggccggtggaggtggacggcatcgcgctgttcgcggagatgacggccggcggcccgttccgctatctggcccactgcggcttcgacggaaaggtggcgcgctatggcggctgagacgggcgcgctgtggtatgtgatcggcccttccggcgccggcaaggacagcctgctggcctatgtgcggcagcgggtgccggccgatggcggcttgatgttcgcgcatcgctacatcacccggccggccgacgccggcggggaaaaccatgtcgcgctcagcccggaagagttcgaccagcgcgagcgcgccggctgtttcgcgctggcctggcggcgcaatggcctggcttacggcttgggggcggaggtgggtctatggcttgcgcaggggctggacgtggtggtcaacggctcgcgctcgtcgctgccgctggccgtccggcgttttcccggcctgcggccgctgtggatcaccgccagcccggaggtgctggcggcgcggctgagggcgcgggggcgggaaggcgaggaggcgattgcgcgccggttggcggaggctgcgtccttcgtgcctcccgccggctgcgcggtgctggtcaacgacggcgcgctggagctggccggggagaccttgctgggctggctgcgggcgcagcggcgcgttctataggccaaaaagggtggcgacgccggagtttgtcgcctggcctgatccaaagaatgggtttgccggcatggagcagcagcctttcagcgattctctacagtggtagaggccgtccgcgctgcggcgcggctgacgcgccaaagttgactccctctgcataaggaacctgttcatggctgaaatcatcttgtatcagaactcgaattttggcgggcgcagcatcgatttgaccagcaactccgccaatttggggacggattacaatttcaatgatcagacctcatcgattcgcgtcgtcagcggcacctggctgctgtacaaagatgccggttttgccagcacctgctggattctgacgcagggcgaatatcccagcccgggcacctggggcggcagcaacgattccatttcctcggtgcgcgccttgccgggcaattacggcgaccactacgcgattctgttccgcgacagcgattacggcggccagatggtgtcgttcactcaatcccaggccaatttcaacgatatcggcttcaacgatgcggcatcttccgcgatcgtcctgggcggcagctggtccatgtacaaggacatcaatttttccggacagagctggatcatcgcctccaataaaggccccggcaacgatggccgttatcccagctactccggcttctgggacaacgacgccgtgtcttcgatccagcccctgtaagccgcttcccgcggcgcggacctgagccgcaagcagggcggaagccattcggtttccgccctgcgtcgtttccgctatggcggatatctgctgggggcggttcagctgtccagcacgaagcgccgcatctgctcctgcagcgcgccgctcacggtcagcagccgggcgctgttctgtctggcgctgtgggtggcatgcaggctttcgtcggcggactgggcgatggcggcgacgctgcgcgcgatggattggctttcgcgcacctgctcggcgatattgacggccaaccggtccagttcgctggaggtggcggtggcgccgtctttcagctcggtcagcgggtcgacgatgccgcggatcatgtcgacgccgcgggccatttccgtctgcccctgttcgatctgccgcatcgcctgggtggtctggtcgtctatcgccgagatcacttcgctgatttcgcgggtggcctgggcggtgcggtcggccagccggcgcacctcgtcggccaccaccgcgaagccgcggcccatttcgccggcgcgcgccgcctcgatcgcggcgttgagcgccagcatattggtttgctcggcgatgtcggtgacggactctatcatgccgcgcatcgaattggcgcgctggcgcagcgcgtccaccgccgccgcgctgccctggatctgcccggcgatcagcgtgatttcgccggaggcggtctggatcaggctctggccgcgcagcgccagcgcggccgcgcttttggcgcgctcctgcgcctgggaggcggtttgcgccgcgctgcgcagcttgccggcgaagtcctccaccaccgcgttgatctggtgaatttccgcctgctggcgctcgacgccgccggcgacttcggccgcgccggactgggtggaggcggcggtggcggcgacgatgtcggcggagccgcgcaattcccgcaccagcgtcgccaggtgcgactgcatctgcgccatccggcccagcatcagcgcggtttcatcgctgccgactatctgcacctcgccgcgcagatccccctgggccatcgcacccatccgcgccacgctgtgctccagcggacgggtgatgctgcgggtgacgcgccaggacagcagcactccggccacagcagcggcggcgctgaaagccagcaataacagccgggtattgcccatcagcgccagcacgtcggccagttcccggttcatgtcgttttgctgggcggaggcgagggcggtggtggcggcgagcagttgctgcagcgccggctgggtctggccggcgtactggcgcgccagcgccgccgggtcgtccgattccacaaggtcgaccgtgttgctgaaggcggcggtgtagcgggcgcgcaattcggatagctggcgcaggacgtcggactgttccggcgtccagggcaagtctttcaggcgttggaaagtctggttggcgcggcggttggcctcgtccatcgcggcatatagggggacgcgctgcggtcggtcgggggtggagatgatctgcagcagcagcagggcggcgttttgcgaatggcggtccagctccgccgccaattgcagcttgccggcgtcgtcgccgacgatgcgatgagtgctggtttctatgctggagaggccgttccagacgctggcgctgaccgccagcagaatggccagcaacagcatgaaggatgcggccaggcgcgggccgactttgatgttttgcaacaagctcatggcggcagggtcctgcgaaggcgaaaccggttggtcggagcagcgctgcggatatgtcagcatagctcgccgcggccggcctgtccgcttgctgccgcgttagtcattcatccagcgcttgtccattccattcgatatcggcggtggaggccgcgagcaagccgcggccccggagcagcccgcggccggcgatttccagcaggcccaggcactgcgccggcagcagccagggttcgtcccgccgggccagcacatcgtcggcgcggccgaagtcggtccagaattcgcggcgccagccatggcgccgcgcggcgaacagcagcatcgccgcggccaccatcttggggctggcggccggacgcagcacttctccgggcggaatgtcgtccagcagggcggcgaccagttgttgcggctggtcgctgaacagatggacgccgctggtggcgcggggattgcactccagtacgtgacaggcgccgtcggcggtttcgatgaagtcgaagcctacctggccgctgtagccggtttcggcgccgaatcgttcgatgaacgcccggatgggtgccgggtcggtgggttcgaaccagacacccgcggctttgcctgcccggtagcgcgggtggtagcaggcatgagcggtcacgcgtcccgccgccagcacgctataactgcagtgctcgcggcccggcatgtagcgctgggcaacccaaggccggctggcgctgggccgcgcgcgcgccagttgggcgggagaggggcgcagcagcgcgcggctggcaaagcgggaataggcaggcttgaacacccagcccggcgcggcgtggcgcatgcgcatgacggcgtccggcgattccaacagccgggtttccggcgcctgggccgtccagccgcgggtcatcagagcgaaacggtgcttgtggtgcaactggcgcatcaggtcgaagcgctcagtcagaacccggcaaggcagggtgtcgcggccgctggacaggtagaaggtttcttcacaggtgggcagcaccaggtccaccccatggcgcgtgatcgcctggcgcagcgcgtccagccagcgcgccggattggcgcgcggcgatggaaggcgatggtaggcatcgaccgcgcggctgaagcggcttatcggccagtgcagcgaatccgccgcgctcacccgccagccggcggcgcgaaaggcgcgagcccattccaggcaggcgggagagcgcgcgcccagtatcaggatgtgtcgcggtttttcggggaaagcaggggaggggccggcttgagtcggtaaaggcatggacgagcgtggattttattttggcgattattttatcagcgacaattctaattgaatttcccggccggcgtccgattattcgccgcaggcgtttgcgccggattcggcgcggatcgcgcggcggatgatgtttcttcaggggcgaatgtcccgccgcgtcatatccgtatggtttcgctgccgctgcggccggttttcttgacgaggtacatggcctggtcggccgcctgcaacaggctgtccgaggtgctcaggccgtctcccagcgcgatgccgatcgaaatgcccagcttgcaggaggcgccggcggtctggaacggggcgtcgaacgcctctatgcatttctgcgccaccgtgttggcgatgccttccgcgccgtcgtccagatcgctgagcagcagcacgaactcatcgccgcctatccgcgccagcgtgtcggtctggcggacgatgttggacaggcgctgcgccacctgccacagcaccttgtcgccggccttgtggcctagcgtatcgttgatcagcttgaagccgtccaggtccatgaacagcagcgccaccgcgctgcgtttgcgctgcgcctgcgccagcgccatgtgcaggcgatcggacagcagcgagcggttgggcaggccggtcagcgagtcgtgatgggccatgcgggccagttcggctttctggtcgttcagtttgtgcagcaggcggttgaacgccgcgatcaggtggccgacttcatcgttgcggcggatcggcatcggctccagcggcagctcgccgcgcgtcatgcggtcggcgtggcgcgcggcctggaacagcggccgcagcacgatgtacaggccgccgcagcagatcagcgcgaaaacgaccatcgcggcgatggtgttgcgcagcgtgaagccctttaccctctccacggtggcgaaggcctcgctgctgggcagccgggccaccacgaaccagccggcgcgcgggaccgacgcgatggcgctgacttcttccacccctttggcgttgacggtgatgccggcgccgcgaaagcccgccatcgccctgtcgtgcagcgggttgacgccggggcggggcagcggcttcagtaccatgtccggttgcgaggaggagacgaactgcttgtcgcgcggcgagactagcagaaaactgtcgatgtggccgccgatatgggtgtgttgcagcagatcgagaaagtttggcgcgtccagcgcggtgacgccaaccagaaccgccttcactttgcgatcggcgccgtatatcggcgcgcccatcggcagcaccggtattttcgaagtgaggccgactacggcgcggccgatgtaggggtccccttgcagcgctgcccggatatagtcgcggtcgcggtaattgactgtcatccgtctgggattgagaggatagtcggcgatggcgctgccatccggcctcactacgaacaagccgatggaaaacagcggctggtactggtagtgctccttgagccagtcccgcagctggggcgggcgcttcagcagctgcggcggcagcaccgcggccaggtggatgagcaggtcttccctttgcgcgactttgccgttgatgtcgtgcgcgacataggtggccagcgtcaactgctggttttccaccaccttgctcaggtcttcatatagaaaattgctcagcgtgtaataacgcgatatggagccggtgagcacgatcagcagcgccagcgccagcaggcgggtaactatgctgtcaaagaggtaccgcaggccctttgaatacaggatgtattgagacggatcgccttggtggcttttccgctcagccatggcttaactcgtgcggtgcgcggcgcttcgtcagccattgctccacctccaggcaggcggcttccagttgcagtaccaacctggggatcgtctctttctgctcggcctctgcggcttgctctaggtgtctggctgcctcggcgatattgtgcgcacctattggggtcgcgtcggtctggatgtcccgcgtggtgagggcgattagcggcaggttgtcgctgattatggcgttgcggatgtatgaggtgtgtcggcgggtgttcttcaggaactcgcccagcagttgactttcggattttccgctctcgccgcagcgtgttcgcagcattaacaggtcgagcggcgcggggccttccggttgagcccccgctgccggggggctaacgctaggaggtgcgccctgcaaccatttttccagcgccgcggacagggtttccagcgcgaagggcttgatgaggtagtcattcatgccggcatcacgggtcttttgcagctcttctggcgcggcattggctgtgcaagcgatgatggcggaacgggggcggacggggtgttccgcctcgtagcttcggatcagcctggcgagttcgaagcctccgatattgggcatcaggcagtcggtcatcaccagatggtaatgatcgcgccgccatttttcaaaagcctgcgcgccatcctccgctgtatcgggccgataaccgagcttttccagctgcttggtggctagcttcagattggtggggttgtcctccacgagcaatatgcgcttttccgcattgggcgctgcggagggcagaagtgcgagggggggaggagctttgcgttcagccacttccacgcacagatgcagtgaaacccgtgtgccatgccccagttcgctgtctattgccacctcgccgcccatgagctctgccaggcggcggctgatagccaagcccagtccggtgccgccatagcggcgggaggtggcggaatcgccttggctgaatggctggaacagcgtttgcaattgttcgggcgggatgccgataccggtatcgatgacgtcgaaaatcaggttttgccagccggtggcctctttttccacttggacgcgcaaggtgatggcgccggtggcggtgaactttatcgcgttgctgagaaagttttgtaagatctgccgcagccgcagcgggtcaagcagcagggtgggggcgagcagaggatcgatctgcaggtcgaaattcagatccttttgctcggcggtatgggcgtagcggcttagcactctttgtagcagtggccagatatcggtgggtgtcttaaccagctccagctggttggcctcgattttggtgaagtccaacacatcgtcgatcagcagcagcaaggtgtgcgcggagtcgcgcgcagtgtccaccatgtcttgctgcccagagtccaattggctcaacttcagcaactccagcatcccgagcaccccgttcagcggggtgcggatttcgtggctgatggtggccaagaaggagctcttggcctggttggccgcatcggccttatccttggcgcgccgcaactcactctctgctgtctttagctccgtgatgtcgcggatgttcaggttgtagtaatctttgcctgtgtccggcatgtgggtgatcgccagctctatcggaaacggcgtaccgtcggcgcgtttggcggtgagttgcagcaaactgctcaatttgatgtcgtcgccgagcagtagcggctgcagcgcgcgccggctggacggttccaggcagtccagcaaggcggtgccgatcaggctgccgcgcggtaggccgaacatgtattcggtcaccttgttggcgctggtgaacaggcctagcctgtctaaggtggcgatgccgtctatcgaggtgtcgatgacagcggataacagtatttgttgccgcgaaagttgaagctgtgtttgttctagcttgcgttgggcctggcttgcctgcatcagttgtcccaatgttttcatcaatggcgccgggagcttgttgccatggtccgggtcgaccgggcgagggaagaacagggtaaacgagccaattacgctggaggccagaatgatggggatgctcaggaaatagtagccttgggataaggcgccggacgaactctgttgcaggcccagcagctgttcctgttcttgatagagacagcattgcaacagctcgtctgtgtccatctgcggcggggggctcagagcaggcgtgatggggagaaactggggctggcttgcctggttgttcaattcgcatataaagccgtgttcggcattgaaccacagcagtaggatgtcgcgggcgtagctgaacaatgtttcgggatgcaccttgccaatgaacaggctttgcatgtaattgattgcatccagcagatcttcttgccgctgtaaatcctttcggctttcttcagcgcggttcagcgcggtttccagctggctgcggtccaaggccagctgggtcgacatccggttgaacatctctgccgtgcgcgccagctcatctttgccttgcacttccacttggtagcccagctcgccggcagccattttttgggaggcctgttgcagcgactcgagctggcgggtcagataggtacccagtagcagagagaacagcgcggataaggcgagttcggacagggcgagcataaggccattttgtagggctttctgcatcaattgccggtggttagccaccgaggtgccgagttccactcgaccgtaatggatgccgccgatctcgatgtttcgggtgatggtgagcggttggtcgggcgagagctggtctatgttctgcgtggctgagtcctgtttggctgagtcatgcagggccaagcttcgaggatcgccggcctcggcgagaagcctgtcatggccgtcgaacacgcgagcatagaggatgtcggaagatttcaccatctgctccgctgcgctctgcagcgttgccaggtcggtgcttagcacagcgttttgattggcttgggcgaactgctcggctatgatctgccgccgtttgatcatttctcgaacgctggtatcgcgcagcaggcccaaaccaaaatacagcaggatacacagcatcatcaattcgatcagcgctatgccgagtatggtcttaagccggaacgacatgtgctattgctctcccggcgcttggtaatgtatgcccaggcggcggatatcgtcccagtcttcatcccgagccgccgtcagcggtttcagttgcacttgctgtagcaaggcgagtccctccggtgtgtcttgcagatgggtcaatgtccgaagcaggcattggcgctgcgtcgaaggcaagccgggccgcgtggcgaacgggtgcggcgtgtgcggcggcgtttgccacaagatgcgcagcgcattgcgcacagcatcaggttgctggctccaggtgcggttgataccgccgcctgccgaataaagaccttgcctgacggcgagatagaccgagtcgtgtgagccgacataactgacattgacatgtacgcccatggactccagctccgcttggggcagtacgctcgcggcgaacgactctggcgcgggaagggccagggttttgccttccagttgacgaacgttctggatggggctgtctttgcgcaccacaatcagcccaaccaaccgggtatctttttccctcgccagcgcctgatagcccgcgctgtcgtgaaagaccacgtagtgcagcgggttgaagtacacgatgtcgtactggcccttggccacccgacgctcaaaagtgggaatgtccggggccgtttcaaattgcagatccagtgtgcatgatttgcccagatattgcagtaagctcccccagttccgcgctaggtggagagcggattgctgcggaacaatgccgaagtggaggataggcgctccagcatttgccgtggatgccaatagcgcggcaggtagcagcagattggcgaggatgaggtgggtcttgcccgatcggggggggcgtaatgccttcatgctttcgtctctcctgcgcgaaacaatgtggcgagatggtgcctgtctttagcgtcaatatagataaaactcagtagatcgcttgcgttgcggatggcgtgcgggcagtggtctagaggggcaaaacaagcttcatgttcttttcactggcttgtcatcgcctagcggcatagtggcagcagttttccagatgggtcggtttgtggatgaatttgtctatacgtctaaacaaaggagcatcgtcgatgaagaagcagctagctgtcgcaatcggtctggccgtgtccggacttttgtccccgctggcatacgccaaaaccacgctgacggtgtacaccgcgctggaggccgatcaggtcaaggattacaaggaggctttcgagaaagccaatccggatatcgatatccgctgggtgcgcgaatccaccggcatcatcaccgccaagctgctgtcggagaagaatcatccgcaagccgacgcggtgtggggcttggccgccaccagtctgatgatcctggaccagcaaggcatgctgcaggcttacgcgcccaagggcgtggacaagctcagcccgcaattcgtcgacaaggccaagccgcccaagtggaccggcatggacgtgtgggccgccaccatctgcttcaacaccgtggaagccgccaagaagaacctgcccaagccggaaagctgggccgatttgaccaagccggtctacaagggccagatcgtgatgccgcatccggcctcgtccggcaccggctacctcgatgtgtccgcctggctgcagatgatgggcgagaagccgggttgggactatatggacaagctgcacctcaatatggcgcagtacgtccactccggctccaagccgtgaaagatggccgccaccggcgaattcccgatcggcatttcgtttgaataccgcggcgcggaactgaaggcgcagggcgcgccgatagacctgatctacccgaaagaaggccttggctgggatttggaagccaccgccatcgtcaaaggcaccaagaatctggaagccgccaagaaactggcggacttctccgccagcctgccggcgatgcggctgtacgaaaagaactacgcggtgctggcgatgcccggcgtggccaagcagaatccgtacatcccggcggattacgccaagcgcctgtcgaaaaataatttcgcctgggcggcgaaaaaccgcgacgccatcctgcaggaatggtcgcgccgctatgaaagcaaggccgcggccaagaactgaggccggagccggcgctagccgcccgcttgcgggcggcttttcgagattcaagcaagatggagttgccgatgaaaccggtcgatagcctgcagggcttgtccgaacacctgtccgtccacggcctgagccgccgcttcggcggcttcgccgcgctggacgcggtgtccctgtccatacgcaagggcgagttcgtctgcctgctggggccgtccggctgcggcaagaccacgctgctcagattgatcgccggcctggacgcgcccgacgacggccgcattctgctgtccggccgcgacatcaccgatgccgcgccggccaagcgcgattacggcatcgtgttccagagctacgcgctgtttcccaatctgaccgtcgccgacaatatcgcctacggcctgaccccgcggcgcgacaaggcgcggcatgaaccgcgggtgcgcgagctgctggatgtggtcggtctgccgggcgctgagcgcaaatatccgtcgcagctgtccggcggccagcagcagcgggtggcgctggcgcgggcgctggccaccgcgccgggcctgctgctgctggacgagcccttgtcggcgctggacgcgcgggtgcgcgagcggctgcgcgacgaattgaaaagtctgcagaagcggctgggcgtcaccacgctgatggtgacgcatgatcaggaagaggcgctggccatcgccgaccgggtggtggtgatgaacgccggccgcgtcgagcaggtgggcacgccggcgcaaatctaccgccagccggccagccgtttcgtcgcccagttcgtcggcgcggccaactggctgccggcgcagcgccagggcagccgcgaggccagggtgggcgcatgcgcgctgcggctggagacgccattgccggaaggcgggccgctgaccctgtttctgcggccggaggacatcctcgtcaaggaccgctgggagccgcggcccaataccctgctggcgcgggtggaggatgtcagcttcggcggcgcgatgacccgcgtccggctgcgcccggagggcatgccgggtcagacgctgctcgccgagctgtgcccttccatgctgcggcgccagccgctggcgccgggcgagatcgtgccggtggagctgccggccgcgctgctgcgcgcctatgccggggaggccgcatgctgagcctggcgctgcgatcggtccgcctggccgctggccgcgccgacggcgaaaaactggcggcggctgcgctggtgtggacgctggcggcgttgctggcgttggcgctgggtttgccgctgctgttcatcctgggcaaggccttcgtcaccgtggatggcgtcttcgccggcctggccaacttcgcccaggtgctggactctcccggcctgatgcgcgccgcctggcatagcctgctgctggcgctgacggtgagcgcgctgaccttgccgccggccttcgccttcggctggtgcctgagccgcagccgggcctgggggcgcggtctgttccgccagatcgcgctggcgccgctgctggcgccgtcgttgatgccggccatttcgctggtatacctgttcggcaaccagggcttgctcaagggttggctgggcggcgccggcatctacggtttttggggcgtggcgctgggcgaggtgttctacacctttccctacgcgctgatgatcatcgccaccgcgctggccgcggcggacgcgcggctgtacgaggcggctaggacgctgggcgccgggccgtggcggcagttcttcaccattaccctgcccggcgcgcgctatggcctggtatcggcggcgctggtggtgttcacgctggtggtcaccgatttcggcgtgcccaaggtggtgggcggcgactacaacgtgctggcggtggaggcgttcaagcaagtggtcggccagcagaacttcccgcgcggcgcggtggtggggctgatgctgctgctgccggcagtgttgtccttcttcatcgagcgcgcgctggcgcggcggcaacaggcggcgctgaccgcgcgggcggtgctgctcgttcccgcgccctcgctgcccagggatgccgcggcgacggcgctgctggccgtggtgtcggcgtttttgctggccttgctgggcgtgggggtggcggcgtcttttctcaaatactggccgtacgatttgtcgttcacgctggcgcattaccgtttcgaccatgtcgacggcggcggctgggacgcctatttcaacagcctgaagctgggcggcgcggtggcgctgctgggcagcgcgctggtgtttctgggtgcctacgtctgcgagaaacagcaggcggcgccgctgggccgcggcctgctgcgcttcttcgccatgctgccgatggcggtgccaggcctggtgctgggcctgggttacgtattctttttcaaccatccggccaacccgctgaacgcgctgtacggcggcatggcgctgatggcggtttgcaccatcgcccacttctacaccaccgcgcatctcaccgtcgccaccgcgctgaagcagctggacggcgaattcgaagcggtggcggcctcgctcaaggtgccgttctggaccaccttgcggcgggtcacgctgccggtggcgctgccggcgctgctggacgtggcgcgtttcctgttcgtatcggcgatgaccacgctgtcggcgctggtgttcatcatcagtccggaaaacagcctggcggcggtatccatcatcaccatggacgacgccggcgacaccgcggctgcggcggcgatggccaccttgatcgtgctgacctccggcagcgtgtcgctgttgtcgctggggctggaaaaggcgttggccagacgcagccggcgctggcgcgagccgggttgaggcggcggcgggcttgccagattggcatgacgggctatatctcaatctggatcgtcaattctttcggcattgccgatcggaattgcggcgggccgcgcccgccgcccgtcatttccgtccagccggggaggtgccatgacccgcccgctttcttgccttgtccgcgccgccgcgctggccctgccgctggcgcttgccgcctgcgccagcctggacagcgccaagttcgccgcgctgagcgaggcggcgcgccagatggacgacggcgccgcgtccagcttcgccgcgctggagcaatcggcccgcgacagcgcggtgctgaccgcgcccgatcgcaaggtcggcctgcaaggctttccgctgctgaatgcccaggggcagccgtatgacctgtccggccaactggacaaagtgaaggcgtcgctggacctgctggcctgctattcggcggcgttggcgcagctggccgccgccggcaaccccgccgacatcgacaaatcgtcgcaggacctggcggccagcctgcgacagttgcagggcagcggcctgagcggggcggcggccaatggattggcgaccgcgatcgacgccttcggccaggccaagctcgcgtcgcagcgcaaggacagtctgcgcgcggtgatggaccgggcgcagccggggctggaggcgctggcgcaggaaatgggccgcgtgcagcaggatttgcagctgtatctgaccgacatcagcctgcgctacctaagctttgtcgaccgcgacggtttccggccggcctttggcagctgggcccgctatcagggcgatctgcaggtggcggcgcagctggccgatttcgaccgccagcaccgggcgctggacctgataggcaaggagtcgcaggcttttcccatcctgcaccggcaactgcggcaaagcctggatgatccgggcgcgcggcaggaccggctgcgcgaattcgtcgacgaagccaagcggctgcgcagcctgtaccggtcgctgcccggttagtaaaccaaggagcgagcgatgaataatcatgatctggccgagcggctcaccgggctggcttcccggttcaacaacctgatgatcgccaccaccggcgacatcagccggcaatgcggcgatctgcaggcgacgctggcgggccagtctatggccgccatctcccgcgatctggacgccgccgccgcacagtacgccgacgcggtggccgcgctgcaggacgcgacgcaagcggcggacagcgcggcgcagcaattgcagcagaccagcaattccatcgcgtttgtggccaaggcgatacagctggcgggcaaggcgtcgggcctggcggcgccattgttggcctgagaaagggcctcgccgtccgagaaaagcgcgcgcgcggcgcttatgtggtccgtctgccaccggcgccggcgccccttgccgcgcgcaagttctttaacaagcttttccttcctttactaaagcgcggcggctgtccgatattgagggaaagccggtggaaaatctgacggccgagcagtggtaaccggtatagccagcatcttctccagatcatgcagcaagggggcggcccaagggccgactgatcatgatagatacttcggaagccaaactcggattgggaaaaggcaagccgtcttcttctgcatggtgggcgctgttcgggctgttcatcgcattgtgcggcctggcggtgtcgctgttcctcaacgaggttcatacctcgcggttccaggcgatgtttttcagccgcgccgcccgccatgccaccttccaggtcgaacctggccgcagcaaggacatgcgctttcccgagcgcggcggcccttacgacctgcgcatgggctattccgacctgccgcgctacctggatcgcttgcaaaaccgcggcttcgccattatcggccaggctcgccagtcgccggacatgatacggctggtggacagcggcgtgaccgggcccttgctgccgctggggctgttcccgccgtatcgggaaaaggaccagtccggcttgctggtttacgacggctatggccgcgctatctaccagtcgctctatccgcagcgggtgtaccgcgatttcgatgcgctgccgcgcctcttggtttccgggctgctgtacatcgaaaaccattcgttgctggacgacagcaatccgcagcagaacccggcggtggagtggtcgcgcttcggcaaggcgctggcggacgagggcctgcacctgctgcggcccggctaccattcggccggcgccagcaccctggccacccagatcgagaaattccgccactcgcccggcggccgcaccggcacccccaaagagaagctgcgccagatgctgtccgcctcggtgcgggcctatcatggcggcgaggataccagcgccgtgcgccgccagctggtggtggagtacctgaacacggtgccgctggcagcgcgcgccggcttcggcgaaatctccggcatcggcgacggcatgtgggcctggtacggccgctcgttcgacgaggtgaaccgcacgctggccagcgacgcgccgctgtcggtgggcgagcaggccaccgtgttcaaggaggcgttcagcctgatgatctcgcagcgcagcccgtcctacttcctcaacggcgacatgaaggtgctggaggcgctgacggactcctacctgcggctgatggcgcgcgacaaggtgatcacgccggaactgcgcgacgccgccttgcgggtgtcgctgcggcagcagcgggaaaaggccagcttcgtcagcaagtcgctggtggagcgcaagggcgccaacgcggtgcgggtgaagctggccggcatgctgggcatgccgcgcatgtacgatctggaccacctggacctgacggtcaacagcacgctggattcgcaattgcagcaggaggtgaccgacaagctgctgaagctgcgcgacccggattacgccaaatcggtggggctgggcgacaaattcctgctgcagcaaggctcgcccggcggcgtcacctacagcttcacgctgattgagcgcacgccggtcggcaaccaggtcagggtgcaggccgacaatttcgaccagcccttcgacatcaacgaaggcaccaagctggatctgggctccaccgccaagctgcgcaccctggtcacctatctggaagtcatcgccgatctgcaccggcagtacgcgggcctggacaaggcggagctggccgccatccggccgaccgagcatgagtcggtgctgcggcgctgggcgatagactacctgaagcaaaacgacgaccgcagcctgtcggcgatgctggcggcgtcgatggagcgcaagtacagcgccaacccgggcgaaagcttcttcaccggcggcggccgccataccttcgaaaacttcgagaagagcgacaacagccgcatcctgacgctgcgggaagcgacccagcactcggtcaacctggtgtacatccggctgatgcgcgacgtcgcccactactacatgtacccggctggctatgaccgcgaggtgatgggcgacaaagacgacccgcgccggctcgcctatctgcagcgcttcgccgaccgcgaggggaaaaccttcatggccggcttctaccgcaaataccacggcaagagcgccagcgagatcgacgccgccctggttgaaaaggcgcgccgcagcgccaagcggctggcggtgatcttccgcagcgtgcatccaaccgagggccaggctgcaatggcggccttcatcgcccgctaccagacgccgccgtccaagatggaccccaaaaacctggccaagctgtacgacgaactggggccggatcgcttcaacctggccgaccgcggttatctggccggcgtccatccgctggaattgtggatggtggcttatctgcatgcccatcccaaagcggggtggtcggacatggtgcaggccagcgcagcgcagcgccaggaagtctaccaatggctgttcaacagcaagcacaagggcggccaggacaaccgcatccgccagatccaggagatcgacgctttccgccagatccacgcggcctggaagcgcatgggttatccgttcgattccttggtgccgtcctacgccaccgcgctgggcgcgtcggccgaccggccggcggcgctggccgagctgatgggcatcatttccaacgacggagtgcggctgccgactgtttacatcgacaaactgcatttcgcttccgccacgccgtacgacaccacgcttgcgcaggcgccggcgcgcggtgtgcgggtgctgccgccggaaatcccgcaactggtgcgccaggtgctgtccgaggtggtggacaagggcaccgcccaccgcgccgccggcgcgttcgaccgcaagggcgagcacgtgctgataggcggcaagaccggcaccggcgacaaccgtttcaagaccttctcccgcggcggcggcctcacctccgcgcgggtggtcagccgttccggcgccttcgtgttctacatcggcgaccactacttcggcaccatcatcgcctatgtggccggccccaaggcggccgactacaaattcaccagcgccttgccggtgcaggtgctgaaggtgctggcgcccacgctggcgccgcggctggatctgacgccgcgcggcaccagccagggcgccgacagcgtggcggaaggcaccccggacttgggcttgccgccgggcactccgttatgcctggtgcccagcctgggcggcatgtgccagttgctgaagcagccgcagatggatgcgctgccgcaacggcggcgcgaggcggactggcgggcggacggccgggaaggttagggcggaagagggtggcaaagccccgcgcggcatggccggcgcggggcttggtgttcgtggcgcgggcgaagggcgctttccgccgccgcgctggcttattccgctccgctgccatggcccagctcttgccgatactggcgcggcgtcagaccagtcaaggctttgaactggcggctgaaggcgctgtggtcggtatagccgcagctcagggccacttcggtgatggccatgtcctcatgcagcagccggtgcgcatgttccagcctggctttgagtatcatttgccgcggcgacaggtggaacactttcttgcagtagcgctccagctgggcgatggacaagccggcgatggcggtgagctccgccattgaaatcggctggctgaaatggcggcggatgaattcgtccaccgccgccaggcgcgtataagccgggtgcgtcttgctggccgactgcaaatccagcgagatgccgatcagcccgatgatttcttcctgccggttgtacaagggccacttgtaggtcagacaccagcctggctcccggcttttgaacagatgcagttccagctggctttccagcacctggccgtcctgcagcaccttgatatcctgcgccgtgtagacctgccccagctggatgggaaacacttcggcgctggtttttcccagcagcggcggcaaatccttcaagccgcagcgctgcgccagcgtttggttggcgcagagataacgcgcctgcctgtccttgatgaagatggccgcgttggggatcaggtccagcaccggcatcagcggggcgatgcccgccagcaagtcgtccatcgtcgccgggcggatttcgtctcgccagcgggcgattttttccacggtttcgttcgtcactccccccacctttctaggcgagcttagccgttggcatccatcgccacctcgccatcccgaatgctctgccgcccggtcaagcatcaagcctatcccattctgcaggttcgctgaaacgcgaactatgccgatttcgtcattgctgctgatgatagccatcaagattgtcggcgacaacgcggccatgctagcagggtggaagcgaatgccggctaggcgcagagattcaatggaatcaaaggcctgcgagacgatggcggggcggccggactgaatggagctggagaatggacaagcgaatcaagcagattgaagtcatagattcccacactgggggcgaacccacccggctggtgctgagcgggtttcccgcgctggcgggggccaccatggcggaccagcgcgatgaattgcgcgagcggcacgacccatggcgccgcgcctgcctgctggagccgcgcggcagcgacgtgctagtgggcgcgttgtactgcgagccggtttcgcccggcgccacatgcggcgtgatcttcttcaacaacgccggctacctgggcatgtgcggccacggcaccataggtctgatcgcctccttgcattacctggggcgcatcgcgcccggcacccaccagatcgacaccccggtggggccggtggacgccgtcttgcatgagaacggcgcggtgacgctgcgcaatgtgccggcttaccgttaccgccggcgggcgtcggtgcaggtgcccggccatggcacggtgatcggagacatcgcctggggcggcaactggtttttcctggtggccgagcatggcctgagcatgcggctggacaatgtcgaggcgctgagcgcgttcagctgcgccacgatgcaggcgctggaggagcagggcgtcaccggcgccgacggcgcgcgcatcgatcatgtggagctgttcgccgacgacgagcacgccgacagccgcaacttcgtcatgtgcccgggcaaggcctacgaccgttccccctgcggcaccggcaccagtgccaagctggcctgcctggccgccgacggcaagctggccgaaggcgaagagtgggtgcaggccggcatcaccggcagccgcttcatcggccgttaccagcgcgaaagcgatttcatccgcccctacatcaccggccgcgcccacgtcacggcgcgcgcgacattgctgatagacgaagaagaccccttcgcgtggggcatctgagcccacgcctctcattacctctaccacctgaatgaatgccgcaaggagcaagacaatgagcgataacattttcaccggttgcattccggcgctgatgaccccgtgcaccgctgatcgccagccggatttcgacgcgctggtggccaagggcaaggagctggtgtctctgggcatgagcgcggtggtgtactgcggctcgatgggcgattggccgctgctgagcgaagctcagcgccaggagggcgtggcgcggctggtggccgccggcgtgccgaccatagtcggcaccggcgccgtcaacacccgcgaggcggttttccatgccgcccacgccgcccaggtgggggcgcatggcttgatggtgatcccgcgcgtgctgtcgcgcggcgcgtcgccggccgcgcaaaaggcgcatttctcggccattctggccgccgcgcccaagctgccggcggtgatctacaacagcccctattatggcttcgccacccgcgccgacctgttcttcgagctgcgccgcgcctatcccaatctgatcggcttcaaggagttcggcggcgccgccgacatgcgctacgccgccgagcacatcacctcccaggatgacgaagtcacgctgatggtgggggtggacacccaggtggtgcacggcttcgtcaattgcaacgccaccggcgcgatcaccggcatcggcaacgcgttgccgcgcgaggtgctgcacctggtggcattgagccgggcggcggccagaggcgatgccgtcgcccgccgccgcgccggcgagctggaatcggcgctggccgtgctgtcctccttcgacgagggctgcgacctggtgctgtattacaagcacctgatggtactgaacggcgacaaggaatacgcgctgcatttcaacgagagcgacgcgctgagcgccgctcagcgccgctatgccgaaacccagtacgcgctgttccgcgagtggtaccgcaactggtcggccgagcagaacgtcgcctgatattcaatccccgccgcgcccttggcggcgcggctgtttacttgtggccatcaacaaatcctcgcaaagcacctgagccaacgcaggatcaggggttttgttcgcggccttcacgcaggaaacatgatgaatctgacaggcatgatgctcatcggtgggcgggcggtcgccggccgccgcgagacgatccgggcgatagacccatccaccgatcaagctctggagccgggctaccccggtgcagaccgcgaacaggtggagcaggcctgcgcattggcctgggaggcgtttgacgcctaccgcgacaccgcgccggaaacgcgggcgcgttttctcgaaaccatcgccgacgaaatggaagcgctgggcgatgcgctgatagaacgcgcgatggccgaaaccggcctgccgcgcgcccggctgcagggcgagcgcggccgcacttgcggccagctgcggctgttcgcctgcacgctgcgggccggcgagtggctggacgcgcgggtagacccggccatgccgcagcgccagccgctgccgcgcgctgatctgcgtcagcgccaggtggctttggggccggtggcggtgttcggcgccagcaattttcccttggccttctcggtggccggcggcgacaccgcttccgcgctggcggccggctgcccggtcatcgtcaaggcgcatagcgcccatcccggcgtcagcgaactggcggggcgggccatcgcgcgggctgcggagaaatgcgggctgccggccggggtgttcgcgctgctgttcggcgcaggccgcgaagcggggcaggcgctggtggccgatccgcgcgtcaaggcggtgggtttcaccggctcgcgcggcggcggcctggccttgtgccggctggcgcaaagccggccggagccgattccggtgtatgcggaaatgagctccaccaatccggtgtttctgctaccggcggcgctgcgggcgcgcggcgaggcgctggcgcagggcttcgtcgcctcgctgacgctgggcgcggggcagttctgcaccaatcccggcttgatcatcgccgagcaaggcccggcgctggacggcttcatcgccgccgcgtccgccctgctgcggcagagtccggcgcagaccatgctgacgcccggcatcttccgcgcttaccaggccggtgtggacgcgctgtccggccatgcccggctggcggccgccggcttgccggccactgggcccaaccagtgccaggcccagctgtggctgactgatgcgcaggcgtatctggccaatcctgcattgcgggccgaggtgttcggcgccgccgccttgatcgtgcaatgccatgacgcgcgggagtttcgccaacttgccgagcagctggaaggccagctcaccgccacgctgcagctggacgagggcgatctggacctggcccacgcgctgctgcccacgctggagcgcaaggccggccgcattctggcgaacggctggcccaccggcgtggaagtgtgcgacgccatggtgcatggcgggccgtacccggccacctcggacgcgcgggccacctcggtgggcacggccgccatccagcgcttcctgcggccggtctgctaccaggacttgccggacgcgctgctgccgcaggccttgaaacaggccaacccgctggcgctgcgccgcctgctggatggcgggcgggagggctgagcgatggcgcccgctcttgcgcccggcgcggccgtcatcgtggtgggcgctggcatagttggcattgctacggctttgcagctgcgcctggccggtttcgaggtgacgctgctggaccgcggcgagccggcgatggaaaccagctacggcaacgccggcgccttcgccgtcagcgacgtgatcccgctggccgagcccggcgtgctgcgcaaggtgcccggctggatgttggatccgctggggccgctggccctgcgttggcgctacctgcccacgctggccccctggctgctgcgctttctggccgccagccggccgcgccgcgtggccgaactgacccaggcgctggccgcgctgctggggcgggtcaatgacgactacgccgcgttgatagcgcgggccggcctcggccatctgtggcggcggcacggcaacctgacgctgtatcgcagccgggaggagttcgacgccgccgcgccggcctgggatgccaagcgccgccatggcgtgcgatggcaggtgctggaccgcgaggcgctggaggaagaagagggcgttgtgggcgaggaatggcgctacgcggtcaaggtgccggcgtggtcccatgtggacgacccctatgtcttcagccgcggcctgttcgacgccttcctccgcgagggcggccgctttgtgcgggacgaggcgctggccacagcgacggaagccggccgcgtggccggcgtggaaacggcgggcaacggccgcctgcgcgccgacgcggtggtgatcgcctgcggcgtgtggagcgaccgcttcgtcaaacaacatcaataccgcgtgccgctggaaagcgagcgcggctatcacgtcaacctgcccaaggccggggtggcgctgcgccacttcatccagtgcgccagcgagagcttcgtcatcctgccgatggccaacggcggcttgcgcctggccggcacggtggagctggcgcaccgcgacgccccgccggactggcgccgcgcccgcatcctgctggacaaggccaggcgcatcgtcggcgatttctccaccgaagacatgacggtgtggatgggcaaccgcccgtcgctgccggacaccctgcccatcatcggcccggcgccgcagccggggctgtggttcgccaccggccacggccatctgggcctgaccctggcggccaccaccggcgcgctgctgcgcgacatgttgcaggggcggactccggcgctggacatgcagccgtatcggctatctcgtttttgaccccgtcccaggctggcagagaccggccgcggcgggggagcggtagcagggcgggccgggtggcttgccctgatccatgcagcaataaaggagacatctcatggcttggaacaaactgtttgcggacgtgaattgggtggtggcgctgggcggcatgatggcgccgttcgccatggcggcggcccatgccgataccgtggtcaagataggcttcgcctcgccgctgtccggcccgcaggcccactatggcaaggacaatgaaaacgccgccaaaatggcggtggacgatgtcaacgccaagggcctggtggtgggcgggcagaagattcagttcgaactggtgtccgaggacgaccaggccgacccgcgcatcggcacccaggcggcgcagcggctggtggatgccggggtgaaggccgtcatcggccatttcaactccggcgtgtccatcccagcctcgcgcatttactcagaagccggtatcccgcaattgtcggtggccaccaacccggcttatacccagcaaggctacaaaaccaccttccgcctggtgggcagcgacagccagataggcggcgcgctggggcagttcgccgtcaagacgatgaaggtcaagaccatcgtcgccatcgacgaccgcaccgcctacggccagggcatcgccgacgaattcgtcaaggcggtggcggccaacggcggcaaggtgacgcgccgcgaattcaccaccgacaaagccaccgacttcaccgccatcctcacctcgctgaaggccgtcaatccggacgtggtgttttacggcggcgccgacgcccaggccgcgccgatggtcaagcagatgaaacggctgggcctcaaggccaagctgatgggcggggacatgctcaacacccccaccttcatccagctggccggcgcggacgcggccggccattactcggcggtggccggcggcgtgctcagcgcccgcccggcgggcaaggcgtttgagcgtcgctacaaggcacgcttccatcaggacgtggtgctgctggggccgcagttctacgacggcgtgatgctggtggccgcggccatgaagcaggcgggctcggtggagccggccaaatacctgcccaagctggccgccatccgctacagcggcgtcaccgccgacttcgccttcgcgcccaatggcaatctgttgaaagcgccggtcacgctgtccacggtgaaaaacaacgcctgggcggtggagacggtggtccgctgagcgcggcagacaaaaaacgaatctaccccggcgactcctccgcccctgagccggctcgcttcatgcggagccggcttctttttcggtgtttgccggcgggtctgttgacactccggcgctgaactgccacccttccggcttcgttttatttgccattgcccgccatgaaaatcactgccaacaccgccgttaccctgcgcatgaaagtcaccgacagccagggcctggtctacgacgacggcaagcacccgatcgcctacctgcacggcgactacgacaacctgttccccaagctggaagccgcgctggagggccaggaaccgggcttccagatcacggtggatctcgccgccgaagacgccttcggcgagcgcgacgaagcgctggccaccaccatggccaaggcggacttcccgcccggcatcaaggtgggcggccagatccagcgccccggcccggacggccagccgcgctactacttcgtcaccaagatcaaaggcccgaccgtcttgttggacggcaaccacccgctgtgcggcaaaaacctgcgcttcgccctcaaagtggtggatgtgcgcgaggcgacggccgaagaaatcgctcaccagcatgtgcacggcgagcacgggcatcagcactgatcccggcctctccccgcacaaacaaaaccctcccgaatcgggagggttttgttttggctgagcggtgcttggggtttggtgtgggtggggccggttgcgatgggcggcgtcaagctgttggtcatgctgggattggtagtttgttagctagtcggctttggtgaatagaagttgtggccttaaatcagttacggagtatcaccgtatcgccatctatttctatttttcttccaaggcgataaattgctaggcactttttaattcgcgtttcagattcacttgttgttctagagatgtgcaaaagtcggcatatgactcgagcaagctcgcttaagctggtggctccatgttgagtcagcacataaaccgctagattgcacagttcttcgagacaaacctcactggactgacccggctcctgtaggcattcctgccttacatctggggccgcttagagtgaaaagaagtctgttggatgcggtcagaaaatcgggcggctattctcctatgccgacctaagctaactcttcaatcaagctgacgtgacctggatgtatcttgaatttcatcttaggtccactctcgtatctggctgcactcgatgcgagtgaagttaagtcaatttcggcctggttgagcaagtccttcaagtattccttagggatctggttttgcacaagcaggggcagcaggcttatgaatgaacagggattgctggcgactaaggccaatatctcccgtgacgtcgggtaggcggtcttatccagccatatactgtaatggtcatcattcgcgttttttgcttttactgtccactgtagccgacgaatgactaggtgttgctgcatgattggccagaagtcgttaccatagaagtcaatacttaacatctcagtggtagcttcccacagcgcttgaaatagcgcggcggattggttaagtatttcgggattgtgagtttcctgtgagttagcagtacagtccagaatccctaggcctacgtcaaccaatgtgcgcatcagtcttgaagcatctgagggttgccattctgcggaaattttataaatgggacggaattcgagaatttccctcagcgcaacgctagagttccacatattcagccagtgactggtgaagttatcgttcaatgcgacggaatacccgagcacccggcaagcatagttgttgggctgagtagcgtgatattcactaacatggcttctaatcgactgacctttggaggagttccactcggtaggtgtcaagctccattcgttgatgaaatctctgacgtccggtgccgggaacctgtcgggctgattcgaatgtagaagtgctagcatggattgataaacccatggctcccaagaaaaattcaattgctcggaaatggttggggagcaaggatgtgggagtttatcggctaatgcccataatatatcttggctactcagagatcgtttttgacccgagttgttatcagggaagttaaggtactggcaagtgagccatgtgccccaacgcttaaacaggccctcgacatcggatcttttggcgatagtatcaacgaaagaagcgagcagagattcgacgtgcggctctaacacagagtgaggatgtccatgcccatcagcaatgtgaatgagttgcatgcttccgtgcctgagcaagctaggtagcaatagggcaccatcccacgagccatcgctttggaaacttgttggagacctgtatgtgaactgttcccataaatcgtagttacggtaaaactcagggctgtcgagtactcgattgatcaagactaggctttgtgtggagttcatccatttaaacaatgtgttgagatcaagctttgctagtaatttaacccatggccaactggagtcatcggtccgactttccctggcatgtccgtaccaaatttcatcgagggtgattggatgggatggatcaaccccatatttctgaagtagctttttttcagcatcggcgaaatgttgttcggctaaatttaagagtgcctctttgaaagcatcatttttcagagctacgaccagtgccacttccgtccacaaatgctcgacccaccatgagtttttggcgagagccctgaaagctgtgtaccggttttcagtttctgaagaggcccaggctgctacaattccgatcaccaaaatcgcctgaattctcggatcgtccgacgcatcgaagtcctcgtgagaaccgttcaagtgagtggtaaacctcttaagagcattctcggcatcatcctggatgcagaagtattctgttacagacgtgatcaataaatcgggaggtgaaaatctaccttctgcgaagtttccaattaacgactcggcgattgtgtatgaattctgcatttcagactcataagcaggtggcaattgccattctttgttcatgactattttttcctgttggcgttggccatcttccaagctgtatcaaaaaactggacagctttatgggcattggcactccagcctctactcgctgcgtttacatctcggtggaagccacctacagtagcgccaaaatgccatagctcttcatcaatgattgcaaagcgatcgtgaatataatcgaagtctttgagggcaaatgagatttccacttttaagggggcgtcgacctttgcgcgatcatttgttacgaagtcttctaattccttaaattctttctcgatttccgcatggtcatcatgatggcctgtcaaaattcttatagtttgaatatggtttgtgaggaaccaatgcacaactttctttattcttcgaccgtggctaggatttttgccgtcttcagaaaatagatgcttatcaattatccacacccgttgcgcggtgctgatagctttctcaaattctcttgctatacgtacgtcatcaactccataccgagccataatggcatcatactctgggaaatgatggtggctttcgccactctgatttgcctcgcaaggtatgagtaattgtggagagaatttcttctctaccaccagtggggtcgtattgacactatttcgtaaagttagcttagccattattcacatcctgcgttccttgcatcgtctgcgcttcagttccgctgcacctcatgcacttatttcgcgtccttcacgtcacgcccacagtgaacgcatggcttctcaagtgccttccgcgggactttgaaatcctcaagaggaagagcgttgttgtagaggcgcagaagatggtcgaggattttctcgccatggggtatacgcatgataagcgttggccgtataccgatagagtttagagaacttccgatcatccatacacgactatcgatcgcgatgaatcgatcatgaaacagactgttttctgtattcgcgacttttatttcaatattgttcttgtgactattttggaagatagctagattttctagcaatttttggtgtgtgtcctgtgtcgcctctctatcaatttcggtacccgttgtcgcttcgttgatctgtttgaaagcactgcttgaagttaggatttgtatcttgatctcgtctcgttcaatagcaaatagatattggggaatctggtttgcgctgaagtatggatcagcgatgaagatgcttgagtgagcgtgcttgaactttttcctgatgtgttcgagcgcttccttgcgttggttagccgtaaaccacgtttgctcatatactgtggcactgtgattaaggagtcgctcattttttgcgtctagcaaacgctggaaagcatttgttgtattcggtgctttccccaatgtttgtgaggacgctaaggtttttttatcggtgacgtactcatttactgcgctcttctttttatccgtctcgggaaccgaaactttaatgcgttgctcgaccacttcaatactcgttttcatttgtcgaatgaactgtcgcatgggagtttgcaataagactccgcgttctgtgtgtgtcaggataagaccggagccatggatagatgacggtctttcaatcacaaccaaaccatcttccggtaccggaactgtatcaaaggaggtgagtatcccttcttgcccttccattgaggtcaggctcaaaccttcaagtttcctgcctgggtggggcttcaaatggatatacaacgattcggaaccgtcttctttaggatcaacgaattgccggactgaatgaacatcgcagtcaggcacagcgagcgccatcccacctagatattcagggtactccctaaaatcgacatgcatgtggtgctctaggaatttgaaggcttcttggcaatttttgctttgtccgtcttggtcaaggaaactcggccattcttgactgtctgaaattcgacgtgagtacctgatgataccaaggttacggaaggggattgaaggacgttcagatttaagcgtgatgtcgtcactttccaagggcacgcccaatacaggccatgttggaaagtcacttagcctgccagcggagaggggcactccatcagagtccttcctggcatcacgaaggggaatgggtgtaccaagttcatcagatgcggttcggtaccaccggatggcttcttctgcggtcatgacgatacggtcgaccgcaatagcgccttcttccttgaatttttttaagtaaggcttggcaggtctcaaaggggcttgcctacctgatgccagcaaccataccgatgcgaacagcaaacgtagaggaggtcgctcagatgtagatcgtggtggtacaaccacagcgacatgcacgaccgcatgttcgaagccgtcagtcaatttactgtaggggttactgctttcgttactttccatgtagtgctcgctatcagtcgaaaatgctggcttaagatatttctgtaaactatcgctaataagttttacttagctggcgacgtcccccagcattgagtagcacgtagcttttttgtccaattaccttgacctccacccgactaaccgagcggtctagtctagagatttccggcttcaaggtgagcaagtcggaactcgctcggggtctggtcgcccagcgaactgtgcggcctgaattcgttgtaatcctgccgccaacgctcgatcttttcacgtgcgtcgtccagcgatagaaaccaatgcacattcaggcactcatcgcgcagactgccgtgaaatgactcgataaaggcattatccgtgggttttcctggtcgtgagaagtccagcgtgacgccttgctcataggcccactggtccagcgccaacgaaataaactcgctgccgttgtcgacctgaatccgttgcggcgtcccgcgcaaggcttgcacatgctgcatcgtagccaccacgtccgcggctttcagtgcgaaatccaccgtgatcgccaagctctcccggctaaaattatccaccacagttaaggcccggattttctggccgttgaacagctgatcggcgacgaaatccatgctccagcacgcgttcaaattggagacggccggccgagcgtggcgatgcgccgctgccactcgccgtttgggccgcttgcgccgcagattcaagccttcctcgcaatagatccggtaggtcttcttgtgatggatccgccagccttcgcgccgcagtaggacgtagatgcggcgcgcgccataacgaatgcgagtggcggcgatcaatccgcgagatcgccgccactcgcattcgttatggcgcgcgccgcatctacgtcctactgcggcgcgaaggctggcggatccatcacaagaagacctaccggatctatttcctcgcaatagatccggtaggtcttcttgtgatggatccgccagccttcgcgccgcagtaggacgtagatgcggcgcgcgccataacgaatgcgagtggcggcgatctcgcggattcgctgccgctccgcacgatcgtctcgagggtgagggcgataaaaataggtagcttgccgcagctgaataacggccgtcgcacgcctaatgctgacgcggtacgcgtcgatcaggaagttggccagctcgcgtttgcgagccggcttcacagctttttttggatgacttcctgcagcatctgcttgtccaggctcaggtcagcgaccatgcgcttgagacgggcgttctcttcttccagttgcttcaggcggcgcagctcgctgacgcccaggccgccgtatttcttcttccagttgtagaaggtggcttcggagacgcccatcttgcggcagacctcggcgatggtggtgccggactccgcctggcgcaaggcgaaggcaatctgttcttcggtgaacttcgattttttcatgacaaatctcctgcccggatgggcttaaatttgccagaaatctctacttttcgccgctacgtttttgcgggaggaggtcaaccagaccacaaaagtgaagtgtgggtaatggaaagtaataaaaaggcccgcgtcctttggggggcgggccttgagtcaacaaaaactcaacaaagtaggttctagaacgggatgtcgtcgtccatgtcgtccatgcgcggggccgctttcggctcctggcggcgcggggcggccggggcttcctggcgctgggccggggcgttgtagccgtagccgtcgtccatgccgccgcccatgccgctggaggcgccgccgcccatttcattgcggccgccttgcaggctcagttcgttgacgcgcacgtccggggaaacgcgcttgttgccgtccttgtcctgccattcgcgcagggtcagttggccgtatacggtcacttgctggcctttggccaggtagttcttcagcgactcaccgcgcttgccccaaacctggcagctgaaccagttggtgctcttgcgttcgccgaagccgatgtcgctggccacgcggaacgacaggacgggttcgccgctcggggtgtagcgcagttcggcgtcggcggccaggcggccgtcaaaggtgatgctgttcattcaattctccggataagttcaaactgcttggcccgcgccgcgaaggcggcgttgcatggcggcggcgcggcggcttggcgtcgcatcggcttgccgatggtaaccaggccggttggccgcattggcgggtcgcagaccgaaaggacagatcggcaaccgggcgcaggcccaatgattgggggctattatacacggcaatcggcactgctttgctatcaatgggcgcgatgcggaaccgctggcgcgggtgagtcaggcgctggccgggaacctgcggcgatgaatagagtctgtctgagtctgtttgaaaggatgaaagcatgaacaagaacgctgtagtggccgccgtggtggcggtaagcctggccggttgcgccaatatgagcgacacgcagaagggcgtgggcggcggggcggccatcggcgccggcgtgggcgcggctatcggcgccttgaccgcgggcggccatggcggccgcagcgcggctaccggcgccgccatcggcggcttgctgggcgcgggcggcggttatctgtggtcgcagcacatgcagaagcagaaggaggcgatggagcaggcgaccaagggcaccggcattggcgtgagccagacggcggacaatcggctgaagatcaacattcccagcgacgcttccttcgataccggcagctacgcgctgaagcccagcctgaagccggtgctggacaagctggcggccacgctgcagcagaatccggtcacctcggttaatatcatcggccataccgacaacaccggcagcgacgcgatcaacaatccgctgtcggtcaaccgcgccaaggcgacgcagggctacatcgcgtcccgcggcgtggacatcaaccgcatcggcatagacggccgcggctcgcgcgagccggtggcggacaacggcaccgtgtccggccgcgcgatgaaccgccgcgtggagattttcgtggcggagccagcgcagaagtaagccggcgtttggtcttggcgtaaaaaagggcggcacccattcggggccgcccttgtcgcgtctggatggcagggagcttagaaggtggcgtctatcagccgcttcacttcggcctcgtcccattgctgctgcgataccttcagatacgccacccggtcggtcagcaataccgaggcttcgtggacgccggccacgccggccagctcgcgcgacagcgcggcggcgtcgccctgccacgattcgccgatgtgcagcattaccgaacgcaccgccttgggcggctgcatgcccagcgaccacgccagccacgacagcatcagcagggtggtgaagccgaacacgccggccgggccgtagtggctgtacagccagccgccggcggccgcgcccaaaaacaggccgaacgattgcgaggtgttgtacacgccgatggcggtgcccttggcgtcggccggggcgatcttggagatcagcgagggcagggtggcttccaggatgttgaaggcgatgaagtacagcgacagccaggcggcgatctgccagaagctgtccagcgccagcgccatgcccagctgggcggcggtcatcagcgcgatggcgccgatgaataccggcttcagtctggcttttttctcgccgtagatgatggccggcaccatcaggataaagcctatcagcgtcaccggcaggtacacctgccagtgctgggatttgtccagatggccggttttgatcagcgcgaacggaatggtgacgaacatcgccatctgcgccgcgtgcagcgcgaagatgccgtagttgaggcgcagcagctggctgtctttcagcacggtgggcaggcgtttggcgttggcttcggtgtcggagtggaagcgcgacaccgtcgggtcgggtatcaccagccatacgcctatcagcgccgccagcgacaaaaagccggtgagggcgaagatgccgttgacgccgatgtatttggccagcaccgggccggccaccaggctcaccgcgaaggtggtgccgatggacatgcctatcatcgccatcgccttggtgcggttttcctcgcgggtgaggtcggccagcagcgcggtgatggcggcggaaatggcgccggcgccctgtatcacccggcccagcgtcagggtggcgatgtcgtgcgcgccggcggcgacgaagctgccgacggcgaacaggagcaggccgccgtagatcacttttttgcggcctatcttgtccgacagcatgcccagcggcagctgcaggatggcctgggtcaggccgtagctgcccagcgcgatgccgatcagggtatggttgtcggcgcccttgagcgtgttggcgtacagggcgaagacgggcaggatcaggaacatgcccagcatgcgcagggcgtagataccggccagccccaggctggcccgcaattcggtggcattcatgcggtgtgtggtctggtttgcgtaatgtgtttaacgaccgcgccggcaaatggatgacggcgcaacattcagcggcgccgcagcgggatctgcctgcgataggcaaagacaggtggagcctgcccggccaagtcgggtatattaacaggttccctgaccgacggtgagtaacagcttcttatggacagcatccgtatccgtggcgcccgcacccacaatctgaaaaacgtcaacctggacctgccgcgcaaccagttgatcgtgattaccggcctgtccggctccggcaagtcctcgctcgctttcgacacgctgtacgccgagggccagcgccgctatgtggaaagcctgtcggcctacgcgcgccagtttctgcagctgatggaaaagcccgatgtggacttgatcgagggcctgagcccggccatctccatcgagcagaaggccaccagccacaatccgcgctccaccgtcggcaccgtcaccgaaatccacgactacctgcgcctgttgttcgcccgcgtcggcgatccgcactgcccggagcacggcgtgccgctgtccagccagaccgtcagccagatggtggaccacgtgctggcgctgccggaggaaacgcgggtgatgatcctggcgccggtcatcgtcggccgcaagggcgaaaacctggacctgttcgacgacctgcgcgcgcagggtttcgtccgggtgcgggtggacggcgaagtgtacgagctggacgcggtgcctaaactggacaagaacaagaagcacaccgtcgaagtggtgatagatcggctgaaagtgcgcgccgacatgcagcagcggctggccgaaagcttcgagaccgcgctgcgccacgccgagggccgcgccatcgccgtggaaatggatggcggcaaggagcactggttctccgccaagttcgcctgcccggtgtgcagctacagcctgccggagctggagccgcggctgttctcgttcaacaacccgatgggcgcctgtcccaaatgcgacggtctgggcgagatcaccttcttcgacccgcgccgggtggtagcccatccggagctgtcgctcgcctccggcgcgatcaagggctgggacaagcgcaaccagttttactaccagatgctgctggcgctgggcgagcattacggcttttcggtcaatgacctggccttcgaagacctgccggagaaggtgcgcaatgtggtgttgcacggctccggccgcgacagcatcgaattcagctatatgtcggagaagggcgccaaattcactcgcgcccatccgttcgagggcatcatccccaatctggagcgccgctaccgcgaaaccgactcgatggcggtgcgcgaggagctggccaaataccagaacaaccaggcctgcccgcattgcagcggctcgcggctgcggctggaggcgcgccacgtgttcatcggcacgcgcacgctgcatgaaatcaaccagctgccgctgaaggaaacggcggacttcttcgagggattggaattcaccggccagaagcaggcggtggcggagaagatcgtcaaggaaatccgcgagcgggtgtccttcctcaataatgttggcctggattacctgaacctgtcgcgctccgccgataccctgtccggcggcgaggcgcagcgcatccggctggccagccagatcggctccggcctgaccggcgtgatgtatgtgctggacgagccgtccatcggcctgcaccagcgcgacaacgaccgcctgctgggcacgctgaagcggctgcgcgacctgggcaacagcgtgatcgtggtggagcacgacgaagacgccatccgcgaggccgattacctggtggacatgggccccggcgccggcgagcacggcggcgaggtgctggtggccggcaccccggccgatgtggccgccagcgagaattcggtcaccggcgctttcctgtccggccgccgcaagatcgcgctgccaggcggccgccgcgaactgggcgaggagcggatgctgcggctgatcggcgccaccggcaacaacctgaaggacgtgacgctggatctgccgctgggcggcctggtgtgcatcaccggcgtgtccggctccggcaagtccacgctgatcaacgacacgctgtacaagatcgccgcgcgcgacttgaacggcgccagcgaggagccgtcgccgtaccgcgagatcaagggcctggatcagctggacaaggtgatcaacgtcgaccagagcccgatcggccgcacgccgcgctccaacccggccacctacaccggcctgttcacgccgatccgcgagctgttctcgggcgtgccgctggcgcgcgagcgcggctacggcccggggcgcttctcgttcaacgtcaagggcggccgctgcgaggcctgccagggcgacggcgtgatcaaggtggaaatgcacttcctgccggatatctacgtgccctgcgacgtctgccacggcaagcgctacaaccgcgaaacgctggaagtgcagtacaagggcaagagcatccaggaagtgttggagatgacggtggagcaggcgctggaattcttcgccgtggtgccgccagtggcgcgcaagctgaaaacgctgatggacgtgggcctaggctacatccgcctgggccagagcgccaccacgctgtccggcggcgaggcgcagcgggtgaagctgggcctggaactctccaagcgcgataccggccgaacgctgtatattctggatgagccgaccaccggcctgcacttccacgatatcgacctgctgctgcaggtgctgcaccgcttgcgcgagagcggcaataccgtggtggtgatcgagcacaatctggacgtgatcaagaccgcggactggttgatcgacctggggccggaaggcggcgccggcggcggccagatcctggtcagcggcacgccggagcaggtggcggcccatccggccagccacaccggccgctatctggcgccgctgctggaacgagacaagaaataaaaccaaggcgccggttcgtccggcgacacaccaccgcacatcaagaggtaggcatgctgagcttaggcaagatcgatcacatccacatccgcgtcaaggacgtggccgcggccctgaaatggtaccagcgcgtgctggggctgagtcaggatgcccgctacaagaccgacggcgagcacaacaacgccatgctggccaacgccagcggcaatgtgcggctggccatcagcgaggacgcggacgcagcggcgtccggggcgcagggcgcggtggccttcgtggtcagcggccaggaattcgtcgaatggatagaccagctggcgggcgagcgcgtcaccaaccgcgagggccagaccatcgcccgcgactcggtgcatgaccaccgcttcttctgcgcgctgtccttcgtcgatccgttcggcaatccgttcgagatcgtcagctacgaccacacctggctggtcggaaaattgaagctgggcggccagctggccgtctgattcgcgagatttccgacacccgccgccagcgggtgtttttctttgaggaggccatcatgggccattacttggtcgacaatcccgcgcctgaggatgtcgctgcgctgccgggcctgacgctgctggaattcggtgtcgactggtgtccgcattgccagggcgcgcagcccttgctggcgcagttcttgtccgcgcatcctggcttgcgccatctggcgctggaggatggcaagggcaagcggctggggcgggtgtttcgcgtcaagctgtggccatcgttcattctgctgcgcgatggcgtggagctggcgcgggcggcgcggccgcaagatgcggccgagctggaggcgctgctcgcgccgtaaaagggtttgatgccgattttgcgcggcggctcgccggctttagcagatttttaggcggctttggctatcttgcctgtccgggcctgattcatgcaaatgggttgcatgggcaggttccgacgtgatggagatatccatgttcgaactgggcaaaagctatacccgcgaagaaatccacgccgtggtcggcggcaacaaacactcctacctgccgcgcaagaagggcaaggtggtggccgcctgcctgcggccggatctgaatccggacgcgccccatgtcatcctgtgcaactcctgcccgccggagcgcaccgccggcgaacagctggcgcgccagggcggggcgatcccggtattcctgaagcagagcgccagcagctgggcctatcagggcatgttccgggtggtgggcaacgaaacccacccgcaagcgtgcgcgccgcacgccgcccgcagcgcctggaccgcggggcagatcaagcaggtgctgacgctggaaaagcaggtgcaattctgaaatgaagcgaaaaatcgggccgggcgccgtggctgagcggtgtccggcccgttcgcgttgcggccgggctagacggccgcctggcgcagaaagcgctcggcttcggccggcgagcggaaatgccgccagcgcagctgcgggtaatcggcttgcgccttggcgtggccgaagtcggcacgcagccggccatggctggaagctacccagcgcagaatggaatcgcgcgacaggaagctctggcgaaacgattcgcggttgccgttccatagttcccggcggctgatgcagcgcgccagcgtgcgccggatggcgcggaaaaacaccaagggaaagtcgtagtccagccagatgatgtcggtggcgcgcgtccaaagcaggtggcgcgccgcgctgtaattgccgctgatgatccagttgggctgatcggcggcatgccggaccgattgcaggaaggtctcggcgggtcgcggcgtccagccggggccccagtacagcgggtcgaggtcggcggcggggatgccggtagcccgggacagtttgtcggcaaacgtggttttgccggagcagctgcagcctacgatcagaatgcgcttggcgtcggtcatggcggggctcggggtgggaggggcggtgattctagccgcgccggcgcgcccggcaaattcttttcgcataaaaaagggccggtttgccggccccttgtcgcttatttaacgcccaatcgccacaaactggtgatttcggcctggcgcgccgcgctcaggccgtcgatttgttccaccgctttcttgtggctgggcttgacgtccagcctgcccagcaccgcgaggccggcctggtctatccattgcagcagttgctcgcgcgaacgcaggcccagatgctcggccaggtcggacaagatcagccagccttcgccgccgggcagcaggtgcgccgccaggccgtccaggaagccgcgcagcatggcgctgtccgggtcgtagaccgcgtattcgatcgccgagctcggcttggccggcagccagggcgggttgcacaccgccagctgcgcccggccttccgggaacaggttggcgcgccgcagctccacccggccgtccagctgcaggcgctgcagattgtcggcggcgcaggccagcgcgcgcgcgtcctggtcggtggccaccacgcgggccacgccgcgcttggccagcagcgccgccagcacgccgctgccggtgccgatgtcgaaggccagctccgcgcccggcagcggggcgtcggccgccaggtcgacgtattcgccgcgtatcggcgcgaatacgccgtagtgagggtggatgcgcgctgccagcgccttcacttccacgcctttcttgcgccattcatgcgcgcctatcaggcccagcagctcgcgcagcgacaccagcgaggcttcgccgccttcgccgtaggcttcccggcaggcctggcgcaagtcgggcgcgcgccgcaacgggatggcgtagtcggcgtccagcggcagcaccagccgcgacaggatctgcgcgcggcggccttgcgcctggcggtgcaggtggaaggattccagcggcgtggcgccgggcttggcgcccttgcggtccacgcgccgcgccagcgcctgcagcagctggcgggcgttctggtagtcgccgcgccacagcagggtgccgccttcgcaggccagcttgtaggcggcgtcggcggacaggctgtcgtcggcgatcacgatgcgcttgggcggcggaagtccggcttcggagcgccagcgggcgctgcgttcggcgccggcttcctgccaatgcgcggtggggtggtcggcggcgccgggctgctggatgtcggtcatggcgtggggtcggaaagggtgggacggcgggaaagggctgaatggtaaacgcaagcggcccggccgtcacctgaaaaacgcgccgggcgggccggcgcgtcgtcagggctcatttcagcttgatgccccagttgtcctccacgcagtgctggtagttgccggcctgcagcgcgctgtacggcgtttggtagctgaccagctggcactggtagtcgtcgccccatttccagtccttttcccagtagatgttgtaggcggcggagctggcggcggtgaagcgttgcatattggcgcaggacagctgctccgcgccgtaatcccagcccaggtcatgggcgaactgcttgtagtagtcgatgcggttctgcgcggcctggcgctcggtgccgccgccgcattcgccgttgatgatctggatggtggtggcgaagttgttgccggcgccggcggcgatgtcggccgcgttgggcacccaggtgccgtctatcacgtgcagcatggacggtttgggcggctgcgggtagacgaagaagaaggtggcggaggcgagattgagccaggtgctggccaccaggtccgggttctgcagcagcaccgactggtcgccgttgttcatcgcctgcgagaacgggccgtagttgtagttgtaggacagctgcttggcgccgcggccgaaatacttcttccagctgccgtcggcgtttttgccgcaggtccataccttgttgaacaccgggtcgtcgcattcggtgttgtagccgcagccggggccgctgtcggtgcagcccatttcgcgcaggtaggccaggccctggcgccattgcggcacggtgtcgctggcgtcgtggttgccggtttcctgggcgaagtgggcgaacatggtggccaggctgtggcgacagatggcgtcggcgtcgcggccgtcgctgtagtcgtcgcagacgccggggaacttggccaccgcctgcaggaagcgagtgtaggtgtagctggggtcgcggcgggtgaagtagtagtcccacttggccgacggcagcaggcgctccacgcggcgcacgttgaccgggttggcggcgcggcctggcgacaccagttccacctggtcgctgggcagggtgcggatggaggctttcaccttgcggaaaaagtcgttgttggtgaggtcggcctcatgctgcagcgcctgctgcagcgtggggatgggcggcgcggcgtcgtccatgcgacgtaccgtcgcgccgacgtgggcgatccaggagcctttgggattggcgcccggcgtttcggcgcgggtcggccatttggcctgccagtcccggccctgccattggacgacctggcctttctggtaggcgatgtgggcattccacggggcggccagggcggagccggccaacagcgtcaaggcgagtgcgacaagtttcatggtggacccttgtgggattcatgccaaatggcacgcaataccactatggaaccaatttgaaatatgtcaaatgatttgcttgcggaaagtcgctgctggagctggcttgcgtcaagggggagaggcggcgggtctgattcggcgatggctcaacggcgcatcgcgctgatccaggcgtcgccggcgtaatgcgcgctgccgaggccgagcgcggagcggaaggtgaccgcgaaacggcggcccaactgctggattgccactacttcaaaggcgaccgtgtcttgaccgtgttgttcggtgaccagatcgcctggctgcaattcatttactttcattcaggtaccaagggcgtgaccgcattgcggccatgcctgaaatatcaacggcgccgatgttgcggcgggcgggagccgccgccgacattggcggtggggtggcggaagttgatgcggcccttggtcaggtcgtaaggcgacatttccacggtgacgcggtcgccgaccagaacgcggatgcggtgcatcttcatcttgccggagccgtaggccaggatttcaacgttgttgtcgagttttacccggaagcgcgattccggcagcatttcgatgacaacaccttccagttcgatcatgtcttctttggacataacgattcctttctcaatacggatagtgcaaaggcccgtgcggccggccattttcgcggccgcgagcgttgcgatggagcttcaattcggtgaccaagcaggctaggggcacacgggcaacccaacgggctaggcaggacatcgggccgctggccggatgtcgaaagtatgaggcagccggcattctaccgctatccagcgcttcggtcagcaaatttgtttatgcgagccgtcgcggcgccggcctggcggggttttcctgcgcggccgctatgcttccggagcgatctgttggccggccaattggccgacgcgcaccagcgccgccaggtaacgctcgtccagcgggtagcagcaggacagccgcagcgcgttgcggtagcggccgccgggcgagctgagcgggccggggatcaggctgatcttctcggccatcgcggcgtggaacagcgccacgctgtcgcagccttccggcaactccagccagatcagaaagccgccttgaggctgggtggcgcgggtgccggccgggaagtggcgggcgatcaggccgcgcaccttctccacgtgggcggcgtagcggcgcttcagcgtgcgcaggtggtggtcgtagccgccggattcgagaaaggcgcccagcgtttccgccagcaccaccggctcggccacggaagaggcgaatttcagcttgcgcagctgggcgtcgaaacggccgccttccatccagccgatgcggaagtccggcgccagcgtcttggtgtagctggcgcagacgatcacccagccgtcctcgtcgaaggccttgaccgccggcgccagcgtgtcggcgaactgcagctcggcgtacagcgcgtcttctatcaatggcacctgatagtggttgaccagccgcgccagccgcttcttggcctccagcggcatgcagcaacccagcgggttgtggacgttgggcatcgccaccagcgcctggatgcgccgttcggccagcagcacctccaccgcgtctatcgacaggccggtttgggggtcggtggggatttccaccgccttcagccccaggctggccaataacggcagcaggttgaagtaggtgggcgattccagccccaccgcgtcgccgtggcgggtgacggcgcgcaaggccagctgcagcgcttccatgcagccgtgggtgaggatgatgttgtccggctgcagcgccatgcccaggtccatgccgcggcgggcgatctgggtgcgcagccgctccgagcccggcggcagcgcgtaggtgctgaccatgccgggctggcggcgcaggatctgccccatcagccgcgccagcttgttgcccgggtagaagtcgccgccgcgcgggcaggccagcgccaggtcgatgaagccctcggtctgctgcgcttgcagcacggtgcctatcaggtccagcaccgcgtcgcgggtgggggtggccgggccgctgcgggtggaggccggccgcgccggcgacggcagcctggcgcgcacgtaatagccggactgcggccgcgcttcgaccaggccgcggtcttccagcacccggtaggcgctgaccacggtgttgaggctgagctggcggctgtgcgcggtgcggcgcaccgagggcagccgcgatccgggcggcaaggtgccgcggctgatcgccagcgacaggtcgtcagccagttgctggtaaagggtggaggcgtggttctgcatgcgcgggccttgtcggagcggtggggcacagcagtcatcatagtggatggtgacagtgtctgaaaatagcaatctgtaaccaggtcaatacggaatttctgattctgtatccatctggcgctccggcttagcatgtgggggtgggcaagggcggtggcgccgcttgccgctttgatggagagaaaacatgcccgaattcgccttgctgtcctatgtcgccctgatgtcgatcacgccggggcccaataacctgatgctggcttcgtccggcgtcaatttcggctttcgccgcaccgtgccgcacatgctgggcatcagcctgggctgcgcgctgcaggtgttcgtcgtcgccatgctgctggcgcaagcgctgggctggctggcgtcgtggcgcttgccgctggccgcggccggctgcgtctatctgctgtggctgtcgtggaagatcgcccgcgccggccggccggaggcgcgcgagcaggccaggccgctgggcttcgtcggcgcggcgatgttccagtggctgaatcccaaggcctgggtgatggtgctgaacgcgtccatcctgttcatgccggccggcggcgccaagctggcggcggccttgctgctggccgtggtgttcgcggcggtgaatctgccgtgcatcagcgtatgggcctggggcggcgagcggctgcggcgttggctggccgcgccgcacgccttgctgatgtacaacctgacgatgggggcgctgatggccgtcaccgcgctatggctgctgtacgacgaactggctccggtgattgcccggatggcatgatgtccttttttggcaggtgattgtctgttggcggccttatttactggctttattcgccttacgatgatgtccatgtccacaccgccgggagaggcgaaatgaaaaagaccgcattgctggtgatcgatgttcaggaatccttccgccaccgtccgttctggaccgagcaggatctgcctgcctaccaggcggcgcagcaggcgctgatcgccggcgcgcaggcgcgcggcgtgccggtgatcaacatcctgcatcaggcgggcgaagacgggccgttttcggcggcctccggcctggtgcgtccgctggactggatgacccaccagccggcggccaccttcgtcaagcacgtgcacaacgcgctgaccgactccggcctgcagacctggctgatcaagcacggcatccagaaactggtgatttccggcatccgcaccgagcaatgctgcgaaaccaccacccgggtggcgtccgatctcggctacgaggtggatttcgtcaccgaggcgacgctgacctttccgatgacgcatgccggcagcggcgtcacctacagcgccgccgacatccgcgcccgcaccgagctggtgctggccggccgcttcgccgccatcgtcacggtggaggaggcgctgcgccggatggcagactgagcgggttccgcccccgctgcgcggcgcctggcgagttggtcgggcgccgcgcgccggcggcggagccgagtccggggcggccatcggcagcctcccaaactgcgcttgccgcttgccgccggcatggcataaggtgttgtcattcgatttgtccagataaggagtagccatgccgcaatccgcatcccataccccgcccggcggcctgccggcctatcggctgctgaccggcccggacgattcggccttctgccagcgggtgagcgaggcgttggcgctgggctatcggctgtacggctcgccggccgccgccttcaacggcgagcgggtgatcgtcgcgcaggcggtgctgtggccggggagcgacgatgccgctggctgatctggcgcaggcgctggccatcgtgctggcttggggcgtgaatttcgtggtgatcaaatggggcgtggccggcgtgccgccgttgctgctgggtgcgctgcgcttcctgctggtggcgctgccggcggtgttcctcgtccggcggccggcgctgccgtggcgctatctggcgttgtacgggctgacgatgggcgtcgggcaattcggctgcctgttttcggcgatcaagctgggcatgccggccgggctcgcctcggtggtgctgcaatcgcaggccttctttacgctgctgctggccagggtgtttctgggcgagcgctggcaggccagccaattggctggcctcgcgctggcgctgggcgggctggccctgataggcatgggcaagggcggcgacatgacggcgctgggcttcggcctgacgatcgccgccgccaccagctgggcggcttccaatatcgtggtgcgcgcgatcggccgcgacggcttcaaggttgagccgctggggctggtgatctggtccagcctggcgccgccgctgcctttcctgttgctgtcgtggtggttggagggcggcgagcggatggccgcggcgctgcgcggtttcgacggccagtcgctgttcgccgtcgcctacctggcttttgtcgccaccatgttcggctacggcctgtggagccggctgctggcgcgccacgccgcggccaaggtggcgccgttttcgctgctggtgccggtggtggggctgatggcctcgcactggctgttgggcgaacgcttgactgcccagcagttggccggcagcggcttgttgatggccggcctgctggccacggtgttcggcggccgtttgctggccgccgccggcgccgggagggccagccgtgcgtgaaatctatttcgtgctgccgcccagcctgctgttgctggacctggccggcccggccgacgccttccgggtcgccgcgcagctgggcgccgattttcgcctgaatttcgtcagcgcgacggccggcgtcggcacttcgctgggcttgccgctgagcggtttgtcgcctttgccggaaacgctgccggacggcgcgctggtggtggtgcccggctccacgccgtcggaacaggcctatgccacgcccgacgcgcgccgcatcgtggcctggctggcggtgcgccgcggccaggccggcgtgcgctgggcaggcatctgctcgggcagcttgctgttggcggaggcgggactgttcgacggccgcgcctgcaccagccaccacaccttgctggagcgtttgcgcggcttggcgccggcggcccgggtgcaggaaaaccgggtgtttgtgcaggatgggcattgttacagcagcgccggcatcaccgccggcatcgatctggcgctgcatctgataggcgaattggccgagccggccatcgcccgcgccgcggcgcgcgaaatggtggtgtatttccgccgctcgccgcaggatccggaactgtcgccatggctggcctggcgcagccatctgcacccggcgctgcaccgcgcgcaggatttgatctgcgccgatccggtgcgggactggccgctgccggagctggccgaccaggtgcatgtcagcgcccgccacctgtcgcgcctgttccgcgagcatgccggcgtcaccgcgcacgattaccaccgcgcgctgcggctggcgctggcccggcagtggcgcgcggcggggctgggcaaggagaaggcggcgctgtcggcaggcttctcctcggcccgccagatggaccgcgcgatggacgcgaatgcctgaggcgtgccgctacgcggcgcttttctcaagtttcatcagttttagccgatgttcgggttgacgaggtccgagaatggttcataccattcgatcaatatctatcggtaactgccatgaaaactgcccgctgcttgccccgtatcgcttctcttgtcttgctggccggcttgtccgcctgcgccgcgtccacgccgccgaaggcgcagccgatgccgatggccgcgccggcgcgcgactccggcatgacgccgacaggagtgggtttcgtcggctccggcgaagacggcagcagcgaggaaaccaaggtgctgatcaaggaggtcaacccctaccaacccatcgtcgtgcgggtggtgggaacgggcgcggcgccttacaccaacagcctgacgccctcgcagcgcaagctgctggcgatgcgggcggccaggctggacgccttccgctccatcgcggagcaggtgcagggcatgaaactggtgggcaatagcgcggtgtccaacatgatcgccaacagcgatagcttccgcacctatgtggacgcctatctgcgcggcgtgtccatcgtctccaccagcatgaagccggacggcaccagcgaggcggtggcggagatcacgctggatcaggagttctacaagcagttcaagaacgcgctggacaagaccggcagcgtgatgaaggcctcgcaggaaaccggcgccgtcggcgcgaccaccagcagcaacagcatgcaggcgatgccagccgccgcgccggcccgcttcagcagcaatttctacgtgaaccagtaaatgaaaagaaacggactggccattgccgcccttgtggcggcatttcttttgagcggtccggcccgcgccgaggtgttttccgccgaaggggtggcgccgctggacaacgggctggtggcggcgcgcgacatggcgctgcgcgacgcgctcaagctgatcgccattcgccagggcgcgcgggtggagtcggcccaggtgctggaaaacggccgcgccagcgaatccggcacgctgacggcgtccggcgcggtgcagggcacagtcaaagtggtgagcgaataccagcagggcaagctgtaccacgtcaaggtgcaggtggacgccggcgatcctgccgccgcagccccgcgtccccgcgacccctcctgcgcgatgccgccgggccgctcgctgcggcgcaagctggtgaccacctatttcggcgtggagcggccggccgaggcttccgacatgccggacctggcgacggcgctgccgaccgagctgtcgcgccggctggcgcgcaacagcatgctgacggtgcgcgacgccaacacggtgtcggtgctggccgacagccgcatcgccgagcccgccgccggctgggacatcgccagccagctgggccagcgcgaggacgtgcagttcgttgtggcgggcagggtgctgtccacctcggtcaccggcaagggcgcgcgtccctcgttcttcgaatccaacaataccagccagcagggatcgttctataacggccccttcgccggcatgttcggcatgggggtcaagtatgtgcccacccagcgccagttcgacgcggaagtctggatttacgacggcctgaccggttcgctgctggccaacgagcgcgtcagcggcctggccaagggccaggtggtgccgccgtcgccgcagcctttcgcctccgccgccttctggcaaggcgactacggcaggctggtggacaagctgatggaccgggcggcgcagcgggtgaacgacatcatttcctgcatcccgttctccgcccgcatcgtccgccaggagggcaagcgtgtctacatcaacgccggcctgctggacggcatggcggtgggggacaagctgctgctgtatcggcgcgtgcccggccagccggtgcgcgacctgatctccggccgcgagctgggcatgccggaaaccctgaacggcgacgtcagcctggtgcaggtgcagcccaacttctccatcggcatcgcgcagagcaacagccagccggtgtccgaaggcgattacgtgcgcttcgtgcccgggcgctgacgcgcgtcaggcgaaagcctggcagacatccacccattgtccggtggtgatgtcgcgcagctgctgcgggctgatgcgcaccgcgctgtgaaccgcgccggcggccggcagcacttcgtcgaaagcctggatcgacacatccaggtagatcggcagttcgctcgccagtccgaacgggcagacgccgcccaccgggtggccggtgatggcttccacttcttccggcggcagcatcttgcccttgccgaaagcgtccttgaatttgcggttgtcgatgcgggcgtcgccgcgcgccaccaggatgacttctcggccgtcgttcaggcggaaggccagcgtcttggcgatgcggccggcttccacgccgtgcgcggcggcggcctccgccacggtggcggtgctgaccggcagttcgatgatggcgatgtgcggcgcttgggccgatagaaactggcggaccgattccaggctcatgggcggttctttcgctggggagattcagccattatttcccgcttcgcccgccattgtgaagcgccgcgcggcgcttagtccgccagcggcagcgccagcgtctccttcacttcctccatcaccacatagctcttggattccttcgccgacggcagctgcagcaggatgtcgcccagcagcttgcggtacatcgacatgtcggcgatgcgcgccttgatcaggtaatcgaaatcgcctgacaccagatggcattccaggatttccggaatgctcatgatctcgcggcggaaggcgtcgaagatgttgccggacttggcctccagcttgatttccacgaataccagcaaggagccgcccagcgcgtgcggattcaggcgcgcgtaatagccttcgatgatgccgtcgcgctccatgcgccgcacccgctcggtgcacggcgtggtggacaggccgaccttctcggccagctcggtcatggcgatgcgggcgtttttctgcaggatgcgcaggatcttgcggtccatcttgtccagcgctttggcggaggaggatattgccttcatgttttcactgtttatatgtgaaatatttgatagtaatcatttgattctcgtcaatttcagtgaaaaaaaccagatgtcaatgcatatactagcggaattcactatctggtagtggcaagactacaaacggagaaagacaatgaaggtaatcgtgctgggcggcggcgttttgggcgtatccaccgcgtggtatctggccaaggcgggttgccaggtgacggtgctggagcgccaggacggcgtggcgctggaaaccagtttcggcaacgccggccagatctcccccggttactccgcgccgtgggcggcgcccggcattccgttgaagggtctgaagtggatgttccagcgccacgcgccgctggccatcagtccggacggcagcctgtaccagttgcagtggatcgccaagatgctggccaattgcaatgaaaaggcctacgcggtcaacaagggccgcatgatgcggctggccgagtacagccgcgacaagatcaaggaactgcgcgccgaaaccggcctgcagtacgaaggccgccagggcggcacgctgcagctgctgcgcagccaggcccaggtggaaggcatggccaaggacatcgccgtgctgcgcgagtgcggcgtggatttcaatgtgctggatccggatggctgcgtccgcgtcgagccggcgctggcggcggtcaagcacaagctggccggcggcctgcagctgcccaatgacgaaaccggcgactgcaatctgttcaccagccgcctggcggagttggcgcgcgccaagggcgtggaattccgcttcggcgtgaccgtggacggcatcgagaacgacggcaagcgcatcaccggcgtgcgcgtcggcgacgagctgctgcgcgccgaccattacgtggtggcgatgggcagctattcccgcgacttggtgaaggagctgggcatcgacatcccggtgtatccggtcaagggctactcgctgaccgtgcccatcaccaacgcggccggcgcgccgacctccaccatcctggacgaaacctacaaggtggcgatcacccgcttcgacgaccgcatccgcgtcggcggcatggccgagctgtccggctacaatctggaactgaacccgcgccgccgcgagacgctggaaatggtggtcggcgatctgtacccgaacggcggcgacatcaaggcggccagcttctggaccggcctgcggccgatgacgcccgatggcacgcccatcgtcggcggcacccgtttcgccaacctgtcgctgaataccggccacggcacgctgggttggaccatgtgcgccggctccggcaaggtgctggccgacctgatcaccggcgccaagccggaaatcagcgtcgacggcctgtcgatgcagcgttacgccaagcagggcgaaaccctggtggtgccggtgatccgtcccgcggtgcaaggggcctgaagcatgcgtccgttgatcgcgacgatacggctggaccatctgcgccacaattatcagctggcgcgcgccgcccacggcgataaaacgctggcggtgctgaaggccaatgcctacggccacggcgcggttcgctgcgcgcaggcgctggccgacatcgccgacggcttcgccgtcgcctgcctggaggaagcgctggaattgcgcgccgccggcatcgcccagcccatcctgctgttggagggcgtgttcgaggcggaagaactgaaggcggtggacgagcatggtttgtggatggcggtgaccagcgaggagcagctgcggatggtcgagcagtcgaatccgacccggccgctcaccatctggttgatgctggactccggcatgcaccgcgagggctttctgccggaaaactatcaccaggcctggcatcggctgcaggcttgcggcaaagcgggcggcatcaccaagatgacccacttcgcccgcgccgacgaaccggaagtgccgatgaccttcgcccagctggaggctttcgacgccgcggtgcgcggcctgccggccggcgacgagtcggtggccaactccgccggcatcctgtgccacccgcgcgcgcagcgcaactggggccgcgtcggcatcgcgctgtacggcgtgacgccgctgccggcaggcttcggccagggcgacgcgctgcgcccggtgatgcgtttctccagcaaggtgttcggcgtgcgcgagcttggcgtcggggagcccatcggctacggcgacaacttcgtcaccgaccgccccactcgggtgggcctggtggcctgcggctacgccgacggctatccgcgccgcgcgtccagcggcagtccggccgtggtggacggccagcgcacgcgcttgatcggccgggtgtcgatggacatgctgacggtggatctgaccgatctgccggaggccggcgtcggcagcgaggtggagctgtggggcgacgcggtgtcggtcaacgaggtggcggcgcaggccggcaccataggctacgagcccttgtgcaatatcaagcgcgcgcatttcgtctaccgttgatcttcgcgcggcttaagacaaagcccggcgtttgcgccgggctttttttttgctgcgcgggcaaggctcagccgcgctgcaccaccagtttttccactctttgcgtcgcgtcgcgggtgcgctcggccagcttgcgcacctcgtcggccaccaccgcgaagccgcggccggtttcgccggcgcgcgcggcttctatcgcggcgttcagcgccaatagattggtttgatcggcgatggactggatggtgctgacgatggcggcgatctcgctcaggcttttttccaattgctggcgctgctggctttcgctgttcagcgcctcggagcgcttttccgcgtcgatgtcggtcagcgcgcccaccactctcagcggcgtgccgtcggcggcgcgccgggtctggccgcgggcgcggaaccagtggtattcgccgtttttgcattgcagccggtattccagatcgtaaggcgtctggccgctgcggtcgttcaggtgggcggcgaaggcggccagcacccgctgcttgtcttcaggatgcaggcggctggaccagctctccagcaggttgggaaattcgtgctcgctgtcgaagcccaactggcggcggaactgcggcgaccaccagaaggcgttgttgccgctgaccgggttggccgcgtccacctccatgtcccataagccgtcggcctgcatggcgctgcccagctcgaagcgggtcatcgcccgctccagcagcgattgctgctgccgctgtccggtgatgtcggacaaggagccggccacccgcagcgggatgccgcgctcgtcgcgcaaggtggcgccgcgggcgcggaaccagcggtattcgccgttcttgcattgcagccggtactcgatgtcgtacggggtctgggcgctgcggtcgcccaggtgggcggcgaaggcgtccagcgtgcgcgccttgtcgtccgggtgcaggcggttggcccagctgcctagcacatcggggaaatcgcgctggtcggaaaaaccgagcagcgagcggaacgtctgcgaccaccagaacacattgtccgggttgaccgggtcgcccgcgaccaccgacatgtcccacaaaccctcgctggcggcgcggttgaccagatcgaagcgggtggagaccagcgccagctgctcctcggactccagcagcgcctcttgcagttgctggagctgccgcgtggtggacaggcgctcttcgtcggcctggctgatctggcggtcgcgcgcctcccatacccgggatagtttctctcccagcgcgcgccagcgctcgttgccgtggatgcgccatggcgcggattcgccgcgcagcgcggcgtcggtggcgttttccagctgatggatcatcttgttgcctgcaaaccacatgggaaggctccagtagattggccagacttcaagcataggccggggagatttccatgaaatatgtataaatacgtgtttggcatgccgccgcatccggctggcatggatgtccggcgcggggcgctgtggttaaatggctggcttttatccgaacgaccagcgtttcgaccgcgttcgcgcatcgaatccgcgcagaatccataaaccgcgatgaatccttcccgtaccgcgctgggcctgttgctggcctgcgccttgcccgcctgggccgacgcgccgccgatcccgcccgacttgcgcgacggcgccgacgcgcgccgcctgctgcaggacaatagccggcgtttcgacgacctgatccagcagcagcggctgcggcagatccagagcggcggcagcgaagtcgccagtccgcaggcgccggtgctgagcgggcgcgattgcctgccggtcaaggggctgcggctggcgggcatttccctgctgtcgcgggaagacgtcaacgccttgggcctgccgcatggcgattgcctggatctggctgaaatcaatcgcttcagccgcgcgctgaccgcgctgtacctgcggcgcggctacatcgccgcccgggtgctggcggaggggccggacgagcgcggcgtgctgacgctgcgcgtggaggagggcaaggtggcggctatccgcagcgacgacgccagcctgcgcgtggccaacctgtttcccggcatggcggggcagccgctgaacgtgcacgacctggaccaggggctggatcaggccaaccgcttgcgctccaaccacgcgacggtggatgtgctgccgggcgagcgcgtcggcgacaccatcatccaattgcgcaaccagcccgactcccgctggtcgggcgggctgacgctggacaacgccggccgcgagtcgaccgggcgtctgcaggccggcgtcagcctgggctgggacaatcccgccggttggagcgatttgctcagcctgtcggcgcagaccaccggcgagcggcaggaggtaaggcacagccgcagcgagtcgctgttttattcgctgccttacggttactggacgttcagcgtcttcgccagccgttccgactatctcaatccgcagcagctgcagtcccgcgtggcgcagttgtccggcgaaacggcgcaaaccgggctgcggctggaccgggtgttgtcgcgcgaccagacccgggtgctgagcgccgacctgcagttggtgcagaaacgggtgcgcaatttgttccaggacgtagagctgggcgtcagcagccccaatctgacagtgctggaggcggggctgtcgcagatgcgcatcctgccgtccggcctgctgcaactggatggcagcctgcagcgcggcatgcgctggctgggcgcggacgcgcccgacgccattcatccgggcgcgcccaatccgcagttcagcaagctgaagctgagcctggcctggtaccagacgctggccttgcccggcgggccgtaccagtggcaaagcgcgctgtccggccaggccagccgcgaccgcctgcccggcgtcgagcaattggacatcgccgacgccagcgcggtgcgcggctttcgcaacaattcgctggtggcggagaccggttggtattggcgcaataccttgtcccggcggctgcagtacggcggggtcacgctgacgccgcgcatcgggctggatggcggcagggtgctgcaacgcggcagccaggatgcctggcaggacatcgccggcctggcgacgggggcgacgctggggcgcggcggcctgacgctggacctggactacagccggccgttgtacaagccggcctcctggcaggccgaaggccacatcctgttcgcgcggctgaactggcagtggtgagcggggcgtggtgtaaatgaaacgaaaacaatcttaagaatgttgtgaataagtatttcaattgatttgatttaaaaaaaaccttagattccaaatcaaacggttgttttaatggtggcgccctgtgtcgcgcggctgtgattttggtttcgaggggatgatgatgaaaagaacaaagttcgacttgtccgtaaccggcaaggtagccgcggcattgacgctggctttcgtattggccgacgccagcctggccggcggcatcaccgcggcgggcggcagcggcgcgcagccgcaggtttccaccgccggcaacggcgcgcaggtgatcaatatcgtggcgccaagcgcggccggcgtgtcgcataaccaataccaggatttcaacgtcggcaagcccggcgcggtattcaacaactcgctgcaggcgggccagtcgcaactggccggccagcttggcgccaatgcccagctgggcggcaaccaggccagcgtgatcctcaacgaagtggtcagccgcaatccgtcgttgctgctgggcaagcaggaagtgttcggcaaggccgccgactacgtgctggccaaccccaacggcatcgcctgcaacggctgcggcttcatcaacatcccgcgcgcgtcgctggtggtcggcggcgccaatctgcaggacggcgccatcgcctcgctgcaggccgccaataacggcaacgcgctgagcatcgccggcggcggcgcgtccggcgtcaacgtgctggacctgatcgcgccgcggctggatgtacgcgccaatgtctcggccgccgacgccatccgcgcgcgcgccggcttcaacaccgtcgattacgccagcggccaggtcacggcgaccgcgccggctccgcaaggcgtgggcaatctggacagctatttcctcggcgcgatgcaggccggccgcatcaatatcgtcagcaccgcggccggcgccggcgtcaatgtcggcggcaacctggccggcggcgacgagctgagcatccgctcggccggcgcgctggcggtgcaggccgcccagctcaagggcaagcagctggcgctggacggcgccagcgtggatatctccggccgggtggacagcgaaaccggcaaggacagcaagcacgacgaaagctggttcatctggaagaccggcgagagcagcagcgcctccagcaagaccgacagcagcgtcaagcgcgcgtcgctgcagggcgacgatgtgtcgattaaggccgcgggcaatgcccacgtcggcgcggccgacatccagggccaggacgtgaagctgagcgcgggcagcctgaatctcgacggccagctggccgagagcagcgccagcagcagcgaccacgcctggaagaactcctgggcctacaaccaggacaagagcagcgtcacccaggcgcaatcggtggcgcgcatcaaggcgcagcatgatgtcgaactgaacgccacggctggcggcgccagcatcgccggcgccagcgtggacgccgggaacaacctcaaactgtcggcgaccggcgacgtgaaattgtcggcgctgctggaaaccgatagcagcagcgacgtcggcaaccgcaagaacgacggcgcggcgctggaaaccggcagctggaacaacagcagcagccagcagcggctggtgcaaagccagctgcgcgccggcaacgcgctgggcgtcaccgccagcggcgacatcgccgcccaggcggcggtattgaaatccggcggcgacgccgtgctgtccgctcagggcaagaccacgctggcgacgcagaccagcgccaacagcagcagcacccagaacggcaaaacctattggggcggcatcggcggcggcggcaaccagaacaacagcgacagcgccaccgtcaacaccggcagcgcggtcaacgccggcggcaagctgttcatcaacggcgacgccggcatcgccatcaatggcagccaggccaagggaacgcagggcgcctacgccaagacccagtccggcggcgtggtcatcgacagcgcgctggacctggcccagacccgcaccgaccagcgcaccggcaccgccttcaacatcaccagcagcgccagcaagggcagcaccagccaagagaccgcggtcggttctgcgctgaagtccgacgccgacctgcagctgctctccgccggcgacgtggcggtgaccggcagcctggtgaaggcggcgcaggcgctgaacatccaggcggtgggcgacatcaaggtggccagccaggccgctgaaacgcacaatcagtcgcaggacagccagctggcgctgcgcggcgtcggcgccgagaccggcgacaagcaataccgcggcggcgtgcggctggaaaacaccagcaccagccagcagctggaccagaccagccagaccggttcgcaattgtccggcggcagcgtcaagctggcggcgggcaacgacctgagcctgagcggctccaagctggaaaccgccggcgacgccagcctgtccggccagaatgtcagcctcaacgcggcgcagagcgccagccacaacgatagttccaccaccgtcagcggcggcggcctctatctgaccggcggcctggacaagaccggcgccggcatcgagttcggccagaacagcagccgcacggtggcggacggcagcgcggcgcaagtttccgaagtgaagaccggcggcaagctggacatcaccgccggcaacggcatgggcgcgctgcagaaccagggcacgcagatcaaggcgggcggcgcggtgaccatcgccgccggcgacgtcagcaaccaggcggccgtcagccagcagtccacccagcagacttccagccactggggcgtggatgtcggcgtcaatgtcgactacagcggcatcacccgtccgatcgccaatgccggcggcagcgtggccaagggcgacgtggccggcgcggcaggccaggcggccaatctgggcgcggccaacctgggcgtggacatcggcgccatcggcggcagcgccagctcgcaaagccagagtagcgcggcgcaggccaccagcatcgccggttcggccatcaacgtggccgcgagcggcgccttgaaggaccaggcgacgcaataccaggcgacccagggccaggtgagcatcagcgccgacagccaccagatgacggcggcggcgaatagccaaacccagagcagccaggccagcgaaggcggcgccagcgtgcgcgtctacaccaccaccggccaggacgtgaacgtcaagggcagcggccagggcagctacagcaacagccagagcgcgtccagcaacgcggtgaccggcgccatccagtccgccggcggcgtcagcatccaggtgaacaacgacgccagctaccagggcgcggccatcaacggcggcagcggccaggccgctatccaaaccggcggcaagctgacgctctcccaggccaacaacaccagcagcagccagcagcatgatgtgaaggtagacgtcggcctgggcatcagcaccagcccgatcgacggcggcagcaagctgggcggcagcggcaatctggcggtgggcaatcagcaaagccaggcggccagcagccaggcggcgacaggttcggtgcagtcggccggcggcatcgcgctgaccgccggcaacggcctgaccgtgcaaggcggcagcctgcagagcggcggcgacgtcaagctgcagtccgacggcaaggtgagcctgcaggccgctaccggcaacgacagcaaaaccggcagcggctggggcttcaacgtcaacgccggcggcaacaacagcaagggcaaggacgcgtccggccagggcttcaatgtcggcggcggcgtgcagctgtccagccagaacgaaagcagcgccagccagtcgggcgcgcaggtgagcagcggcggcgcgctgagcgtggccgccggcgcgaccggcaacaacgccatccagctgcaaggcagccaattgggcggcaagacggtcggcctgacggccgataacggcggcatcagcctgcaatcggcgcagaacagcagccagaaaaacgactggagcgccagcgccagcctgggcggcggcggcaacagcagcgtggccaaggaaaacggccagcccaaggccgacggcgcgagcaagacctaccaggcgaacggcggcttcgacgtcaaggtggaccagcaggacaagctggccaacgccaacgcgacggtcaagggcgaccaggtcaacgtaaaggccgatggccaactgacgctggctggcggcaacatcgccggcggcaaggtggacggcagcgtcggcggcaacgtggtggtgcaaagccagcaggaccgcaacaacagcacccaggtggaagtgggcctgaacgtcagcagctccaacgccaaggcccccagcgtggtggaccaggccgcggccgtggccggcccgctgtccggcgcggtgaaggacaaggcgactgacgcggtgaacgcggtggctgacaaggtgcagggcgctccggcagcggcagatgccaagccgggcctggtggacggcgcgcggcagcaggccggcagcacgctgaaggacaagctgctgaacccgcaggacaagggcacccaggtgtcaggcgtgatcgacgtcagcgtcaagaccgacaacagcgtgggcagcgtcagcgccatcagcggcgaccagggcgtcaatctcgcggtgggcggcaaggcgcagttgaacggcggccagatcgcctccagcggcggcaaggtgaacctgggcgacgccaaggtggaaaccagcgacatccagaccagcagctataccggcgccggcggcgtcaagctggacggcacgccggcggccatcatccagcaggcggtgaaggatgtcacctccggccagatgccgctgatccatgtcgagcgcggcagccagaaccagactgtggccggccaggtgaagtcgggcagctgaaaaccggcggcttccgcctgagggcgggctatgctgactccatggcggagtcgcatggcccgccttttttgatgccgagggggggggcggaatgacgtgtgaaaacaacgcgcgcatcctggtggccgacgaccatccgctcagccgcgagctgctgaggcagatgctggagcatctgggcgcggaggcggatttcgccgccgatggcgaagaggccgtcgacatggcaggacgcgcggattaccggttgatcttgatggatgtgaaaatgccgcagatgaacggcctggaggctgccttgaggattcgcggccggcgggagcggccgcagccctgcatcgtcgcgatgaccgcttgcgcgtttggatgcgagcgcgatggttgccgggaggcggggatgaatgccgtgctggtcaaaccgttcaagctggaggaattgcggcgcgtattggcagcctgtttgccggatggcgcggggggagactgctgcccgttgtagtggtggagtctcgcaatggaaaacggcagcccgcgggctgccgtttttgcgcggcgaaggcttagaagcggccttcgctgtagtcctccatcgcttgctcgatctcctgccgcgtgttcatcacgaacggcccccactgcgcgatgggttcgcccagcggccgcgccgccagcagcagcagccggctgggcgcgccgccattggccagcaacaggccttcgccctcattgtccagcaccgccagctggcgcgcgcggatgtcggcgccgccggcctgcagctcgccctgatagagataggcgaaggcatggtgcccggctggcagcggtagccataggctgccgttggcgggcagcgcgatgtccaggtacagcggctcggtggaggggcgctcgatcgcgccgtggcggccgtcgaagcggccggccagcagcttcagctggttgccatcggcgtcttgccagctggggatgtccgccgcctggatgtcgcggtagcccggcgcagtcatcttgtccgccgccggcagattgatccatagctggaagccgtgcatcaggccgtcctgctgctcgggaacctccgaatggacgatgccgcgcccggccgtcatccattgcaggccgccggggccgagcaggccttcgttgccggcgttgtcgcggtggcgcattcggcccgccagcatgtaggtgacggtttcaaagccgcggtgcgggtggctgggaaagccggcgatgtagtcgtccggattgtcggagcggaattcgtccagcatcaggaaagggtccagccgccgctgcagcggctgggtcagcacccgcagcaagcgcacgccggcgccgtccgatacttcctgtccgttgacgatgcgttccacttttctgctgcgttttgacatggcttggctccagatgaatcacgatgaccctattgttgcagtgaaaaatcagataaaaaagcgcaaaatactgtgcaaaatgatcaagaatttagataaatgaagccattcaggacgacgctggaacaatggcaggtgctgcaggccattgtggaagagggcggtttcgcccaggcggccgcgcggctgcatcgcagccagtcggcggtcagctacgcggtggccaggctgcagcagcaactcggcgtggaattgctgcggcctgacgggcggcggatgcgcttgaccgccgacggcgcggcgctgctgcgcgaagcgggtgatttgctgcaggcggcggaccggctggagcggcgcgcgcagggtttgcaggcgggctgggagccggagctgcgggtggcgttggacagcctgctgccgaccgaggtgatgctggccgcctgcggcgatttcgccggccactgccgggaaacccggttgcagctgcgcgaagtggtgatgtcaggcgccgacgacgccttgcaccagggcgaggcggcgctggcggtggcggggagggtgccgcagggctttttgggcgattggttgctggacgccgagttcgtcgcctgcgcggcgccggggcacgcgctgcacgcgcaaggcgggatgctcgacgaggccaggcttcggcgcgaagtgcaggtggtgctgcgagattccggcagccggcagccgcgcgacgagggctggctgggtgcgcatcagcgctggacggtgtcgcagccggaaaccggcatcgcgatggtggaggccgggctggctttcggctggctggcgcggcaccgcatcgccgcgcaactggctgacggcaggctcaagcccttgccgctgaagagcggcgcggtgcgcaaggcgtccttgtatctggtgctggcggatccgccggcggcggggccggcgtgcctgtatctggctgaggcgctgcggcgcgcggctcaggcctggatagccgcgctggctcagtgattggcctgctggcctttcagatagctttccagcgcgtggccggcggaaagaatgtggaagcgcaggaattccgccgcctcgtccgccttgccctggcggcacatttccagcagccgggtgtgctcttcgtgcgcgcgctccatggtgcgggtgaacagaatctgcatccgggtatagcggtcggtcttgttgtgcagctgttcgatcagcgccagcgtgttggggcgcttggcggcgcggtacagcgccaggtggaagcgcgagttgatctcgccccagtggcgcacgtcgttgttgtggagggcggcctcgaattcgcgcagcgtctgctgggcggcgtcgtggtcggcctgggtctgacaggggatggcggccttcagcagcgagccttccagcatggcgcgcacttccagcagctccagcacgtcttccagcgacagcttggaaaccagcgcgcccttgtggtcgatgatctggatcaggccttcggcctcaagctggcgcagcgcttcccgcaccggcacccggctgacgccgtattcgttggacagcgcctcttggcgcaactgttggccgtcggcgaattcgccggacaggatgcggcggcgcaaggattcggtaacggcactggtaagcgtctggcgcttgatcggctgcagggtggtcatggtgggtatcgttatctgtcagtcaatcggatacatgcaaatgtattcgattatacggagcttcattgttcaggcaagcggcaaaattgaacattttcgtcgcgaatctgtaattcttggctgccggggtgaaaaagccggcggcggggcggatttttcgcttcccccatgggcgtgggcgcgatcggccagccgggaaatcggcaggggcgccggttgcggcccgcctgtttgagcgcggtgcgcacggcgcagggctggcgcaaggcgtgccgggtgagtcccgatggctggcacttttgcatgcttggctttcgcggcaaggccttatccagtgcccaggcgaggagcgcgcctgtggcggaggcgttgcctgaaagtagcggcgcagtctcaatttgatgcgctgcggcgcatcgggatgcgaaaaaggccttggtttcgaaagaagccaaggccttttgcatgttttggggtggataatgggactcgaacccacgacaaccggaatcacaatccgggactctaccaactgagctatatccaccgctgaaacggctggtttcacggcgcagccatgagaccgataaactgtggggtggataatgggactcgaacccacgacaaccggaatcacaatccgggactctaccaactgagctatatccaccgctgatcgccgatcagacttgctgtccgacgaggaggcgaattatatggggacattggccggagcgcaagcatattgtgcaatttcgtttgaaagcgtttgcgcggcgatttggactggttttgctttgtcgtctggatggttggaaggctggcgaaatcggtaggcttggaccggtggcgaggattgggcggcggcggaaatgcaaaaaagcggccaaatgaatggccgctttctgcgtaattcgtggggtggataatgggactcgaacccacgacaaccggaatcacaatccgggactctaccaactgagctatatccaccactgggtactgctatcaagcaagcttggcgcgcccgacaggaatcgaacctgtaacccccagcttagaaggctggtgctctatccggttgagctacgggcgctctatcgggctgcttgtctgctggtcggggcggcgggattcgaactcgcgaccccctgatcccaaatcaggtgcgctaccaggctgcgctacgccccgaacagagaacgcaactatacggatggggctttggcctgtcaatgcctttgctgaattatttttcatgtttttctcgggtattttgagcatgaaatatttgcctgcggcatttttccttatatctcttgagcttaagagaaataatcctggcgggccgtcttaccgcgctgcggaaaaaatgcgagaatggcggccgttatttatctgcgtcaagatgggattcaggcatgtcggcacaattgatcgatggcaaggcggtagcggaaaagctggtggagaaagtgcgcgaaggcgtgggcgagcgtttgctgcagggcaagcgcgcgccggcgctggcggtggtgctggtgggcgacaacgcggcatcggcggtatacgtcggcagcaagaagcgcgcttgcgagaaggcgggcatccgctcggtggcttatgacttgccggccaccaccagccagcagcaattgctggaaatcatcgacgacctgaatgccgatgccggcatcgacggcattctggtgcaattgccgctgcccaagcagatcgatccgcaagcggtgatcgagcgcatcgatccgaaaaaggacgtggacggcttccacccttataatgtcggccgcctggcgatcaagatgccgctgatgcggccgtgcacgccgcgcggcgtgatgacgctgctggaggagtacggcatcgaccccaagggcaagaaggcggtgatcgtcggcgcgtccaatatcgtcggccgtccgcaggcgctggagatgctgctggcgcgcgccaccgttaccgtttgccatagcgcgacgcagaacctggccgaagaagtggccggcgccgacatcctggtggcgggcgtgggcattcccaacttcgtcaagggcgagtggatcaagccgggcgcggtggtgatcgacgtcggcatcaaccgcctggaaagcggcaagctgtgcggcgacgtggagttcgacgccgcgcgcgagcgcgccggcttcatcaccccggtgccgggcggggtcggtccgatgacggtggccacgctgctgcagaacacgctcgacgccgccaatcagtacgcctgagtccgccatcgccctggcggcgttgacggccatgctcgccacagccaccggcgccgccgggctgtggcgattttgtttgcgccggcgcgccggattgcagacagcggcgcccggctgttttagtattaggtgaaactaaattacggatttgaacatgagtcacgaaaaacactcggcgacgctgctgatgagcgcgccggacaaaaaaggcctggtcgcggccatcgccaatttcctgatgacctacaatgccaatatcatgcatgccgaccagcatcaggataccagcgaaaacctgttcctgatgcgggtgcagtgggacctggatggtttcaccctgccgatggacagcttcgcggccgctttccagcccatagccgacgaacacaatatgagctggacggtatcgctgtcggcgcgcaagccgcgcatggccgttttcgtgtcgcaatacgagcactgcctggccgacctgctgcaccgctggcgcatcggcgagctggagtgcgacatcccgctggtgatctccaatcacgaaacctgccgccgcctggtggagttcaacggcattcccttccatctgatccaggtgaccaaggacaacaaggccgaggccgaggccgagcagttccgcctgctggaagaggcgggcgtcgatttcatcgtgctggcgcgctatatgcagattctgtccggcgagttcgtcgagcgctacccggaccgcgtgatcaatatccaccacagcttcctgccggctttcgatggcgccaagccctaccatcgcgcattcgcccgcggtgtgaagctgatcggcgccaccagccactacgtgaccgaggatctggacgaaggcccgatcatcgagcaggaggtcacccgcatttcgcaccgcgacgcggtggaggatttgatccagaagggccgcgacctggaaaaagtggtgctgtcgcgcgcggtgcgctggcatctggacaaccgcgtgctgtcgtacaacaacaagaccgtggtcttcgattgagcctgccatgcgtttgttgatcgacgatgtgctcgatttgctgcggctgcgggtcaagccgctggccgtctaccaatatccgtggtggcaaccggcgctgctgctgaccctgctgggcctgatcgccagcggcgacaccgccgagcttggcggcaacatcgccggccgcatcggcttcatggtgttgttcacctggctggagacgctgctctttacccgcttcatcaccttctggctgcgcctgtccaagggcgagctggccgcgccgctgttcggcctggtggtggtggccagcggcctgcagttcgtcgagccgctgaccagctggctaccggacgacgcggccgccgtggtggacgtcctgttgtctctgatcggcctggtggtgctggtgaacgcgctggccgtggtgtcggcggtgtcgcgcctgcgggtgttgctgggcgtggcgctgttcatgccgctggcgctggtgctgctggcggcgactttgtctttcgccaagaccgccggctgggtggatttgccggccgacatggtggcgatgatgcaggagcggggcgtggcggtttcggcgtcggagccggcggccaaggctcgctagacccatcggggtcatgaaaaaagggcatgcccgcaggcatgccctttttgtttcaaggccggggcttagtccaccttggcgatgtagcgcgccagccccagcagcgcgcgcagggcctggcccttggcggtttcctcgccgcgcagcctggcgtagcggcgcaggatggcgcggccctccacgaacagatccatgtcggtgtccggcgacgacaccagcgcgatgcgttcgatctcgttctgcggcttgggctggccctgggcgatgcagaggtagaccttgtgcgcgttgaacggcgtgatgtggtcgaacagataaagcatggagttgatgcgcaggccggtttcttcgcgcacttcgcggatcagcgcctgggagcgcagctccccgcggttggccttgccgcctggcagattgtaacggccgccgcggctggcggtgaccagcacgccgtcgggcatctcgatgatggctgtggctcgcctggccaggtcgctgggcaggcgttcattcttgcgttcttccaaaacactcattcttccgaaaagtcattgttaatgatgaggtcttgcgcctctttgatggcagtcattctaaaacagatggcgctttagtagagcgccatctgtatttcaataagtggaattactgtctacttgcaattttataataggcgtcgcccaagtccagtctatttacacgaatttggccgcgaggccgcctatgcccaccagcaggcagtaaaagccgaaggggcgcagcgattcgatttcggttttcttgaagtagcgcatcaggaaccaggtgctggcataagcgcacaggccggccaccgcgccgcaggccagcagcaggccccagggcgccggggcatggctgtgggcgagcttggggatttccagcacgccggcggcggtgatgatgggggtggccagcaggaaggagaaacgggccgatgacgcgtagtccaggccgtgggcgaggccggtgaccagcgtggcgccggagcgggaaaagcccggcagcagcgccagcgcctggccggcgccgatcttgatcgccccggccaggctgagttcggacagctcgtgcgaggcggtttttttcttcaggcggtcgccccacagcagcatcaggccgttgagcgccaggaagatcagcaccgcggtggtgctggtgaacagctggcgcagctgtttttccagcagcaggccgagcaagccggccgggatggtgccggcgatcaccagccacatcagccgcgcttcgggattgctggcgcggccgcgggccttcagccagccgccgatcagcgcgatccagtcgcggcggaagtaaatcagtagcgcggcggcggtgcccagatgcagcatcaccatgaagggaaggaagtccggatgggtgcggttgatcgaccagtgcagccagtcgggaatcagcacgccatgccccaggctgctgacgggaaacagttcgctgattccttggatgacggcaaacagcaaagcttcgattgcgttcatggacaacccctgttcaagtgatgatgcggcggcagccggcgaattgccggctgcccatggttgttttgcataacgcgcgcgccggcgcggggtttacccggctcagtgcgggcggcgctcctgttgctccagcgcttgctcttcctgttccagctggcggcggatcgcggcgaagaagtcatggatgccgtgcaccgacggcgagatggcggccagccaggccgcgcgctgctccgcgctgacggcttcgacgaagggacgcatttcggcgtccgggtggcgttcgaagcccagcgccaggatgggttccagcagcggggcgttttcttccgattcgaacagcatgccccagtcgtcgttcagcaattccatgccggcgatgaagccctcgcaccagtcgttgcccagcaccgcgccgttggcgtcggcgtccagccagggctggaattcgccgccggacagcgcgttggaaatatcctgccagtggccgcgcagcagcgcgacgaactgttccagcgatttttcgctggggaaggcgctttcatcgtcgaaagcctcgcccaggatcagcggcaggcattcggccggcggaatggcttgcgggccggacaacagggcggagaagaagccgtccagctgttccagattcatgcattgctggctggtgaagcggttcagggtggcggacaggcgctggtagtcctgctcgctgagcggcttgtgcggcatattgggctttctgagagggtatggcggccattatgccgccgaggcggccaaaacaaaaccgcccgcatcagcgggcggcgggaaactcggggcggcggggccgattagtaggaagccaacaccaggccggcgatcagcgcggacagaatgctgaccagggacgagccgtaaaccagcttcaggccgaagcgggacaccatattgccgcgatcttcgtccaggcccttcaccgcgccggcgatgatgccgatcgagctgaaattggcgaaggacaccaggaagatggacagcacgccgcgggtgtagctggacaggtgggcggcctggttcttcagttccagcatggcgacgaattcgttggtcaccagcttggtggccatgatgctgctggcggtcagcgcttcgtgcgtcggcacgcccatcagccaggcgaacggccagaacacgtagcccagcatggtctggaagttgatgccgaagatggcggtgaagatgaaattgacgcaggcgatcagcgcgatgaaacccaccagcatggcggccacgatcacggcgatcttgaagccggtcaggatgtactcacccagcatttcgaagaaggacacgcggtgcgcgtcgctgctgatcagctcatcctcgcccagcgcgctgtcgtaggggttgatcagcgacagcacgacgaaggtgctgaacaggttgagcaccagtgcggtcaccacgaagcgcggctctatcatctgcatgtaggagccgacgatggacatcgacacggtggacatcgcggtggcggccagcgtgtacatgcgcttctcgtcgaaggtgtggatgatgttcttgtaggcgatgaagttttccgactggcccaccatcatcgagctgatggcgttgaacgactcgatcttgcccatgccgctgatcttggacagcacgaagccgaccgcgcggatcaccaccggcagcacgcggatgtgctgcaggatgccgatcagcaccgagatgaacacgatgggcatcagcacgttcaggaagaagctgaactcgcccttgttctggatgccgccgaaggcgaagtcggtgccttccttggcgaagtccatcagcttggtgaagacgctggagatgctgccgacgatggcgaggccgtaagtggtgttcagcaggaagaacgccagggcgatctcgatgaccagcaactggatcacggagcggatcttgatgttcttgcggtcgcgggcgaccagctgggtcagggccagcacgaccacgaggccgatgatgaattggacgatatgcatgagattagtatcgcttttgggtttcccctgccttggcaggtttcgagcaacgtttcggtcccgcaagcgggccgcacgccagtttttatagggctgcgggcaaagccgcggccgccgcgccgccatgttccggggatatgacgttgcggcagtagggacaatgcgctgaagttcggatgaaaactagtctttacatcaaactatctatctttaagtgaagatagatcggccgctatggcataaacgccacaggcggccggcggtttacgcctggggagacgagtcttcgttttcgcggcgcgccttctccgcgaaatagtgggcgcggcgggcttccttggcggcggccttttccgccagctcggcggctttcttggccttctccgcgttttcctccgccagatgcgcggccttggcggcctcgcgctcggcggcttccaacgcctcgatttcctcgacttccttgcgcgtcttgcaggggctggttttttcgaaccaggccaccgactccacgtgcgcggtgtgcgggaacatattgatgatgccggccgtcttcagcgtgtagcccttggtgttgaccaggatgccggcgtcgcgcgccagcgtggccggattacaggacacgtagacgatgcgcttgggcgcggtttcctcggtgatggccttcaacagctgcaccgcgccgtcgcgcggcgggtccaccagcatcttgtcgaaatggcccagcgcggcgaacgactcctcggtcacctcgaacaggttggccatttcatagctcaccttgtcctgcaggccgttgtgggtggcgttttccaccgcgcgcttcaccagcggctggctgccttccatgccgtgcacgatggcgccggaacgggcgatgggcagcgtgaagttgccgatgccgcagaacatgtcggcgatgcgctcgcccggctgcgggtcgaggaatttcagcgcgcgcgccaccatcaccgcgttgatctgcggattcacctgggtgaattcggtggggtagtagggcatttccaccgcgtattccggcatgctgtaggtcagcttgggcgcgtccagcgggtagatcggatagcaggtgtccgggcccttgggctgcagccagacctgcagcggacgctcggcggtgccgtgccggtcggagaatgccttcaggatggcgaagtcggcatcggtgatggcgtccatattgcggaacaccaggatgtcgagcttgtcgccgaccgccacttccacctgcggcatgcgctggctgatggacagcgtggcgatcatcgcgcgcagcggcatgatcaggtcggagatgtgcttgggcagaatgtggcactcgcgcatctcggcgatgtagctggagcttttctcatggaagcccaccagcacgccgcccttcttggccaccatgcgtgcggacaggcgggcgcgatgacggtagtgccaagccggtccggcgatgggggtgagaatgcgttcggccttgaccttgccgatgcgcttgaggttgtcttccagcacgcgctgcttgatcgccacctgggcggtgaattccacgtgctgcatcgagcagccgccgcaggtgccgaagtgcgggcagcgcggctcggcgcgcatgaagctttccttcaatacggcgctggtctgggcgttttcgtagctgggcttcttgcggtagctgctgtagacaaccttttcgtacggcagcgcgccatcgatgaaaatggtcttgccgtcaacgtgggcgaccccccggccttcgtgatccagcgattcgaccagggcaatagtctgtgggtgcgtcatcgtcttgcttgcaaaatcaaacggtaaacgcggattttctcaaaaaccggcgattcttgctggtttttttacgttgagggagcgggcggggcggtcggcgcaagtcgctaggagtcagttgccccatgccgcaggcgggcgctctttactccatgaagacatcgcagacgcggtggccggcgcttgccggtcccggcatggcttggctgagttgcgccgggccgcgcggcagtcggtaatagagcggtatgatctgagaagtgtttgtttgcccagacagctgcagctgctgggtttgacgaattgatgcttggcggggcggtgtaaattcgcacaatccgggccggcggggctttctgttacaatccgaaccatgttcatgtaattcagggcaaggtatgttgaagtgcttatcggtgctggcgctggggggctcgctggcgtttccgtgcgcggctgcggtgatgccggcgccggacatccaggtgaacccggcgggacgacacctggtgctgaacttgccgcaggcgcggctgttcctgtaccaggatggcaagctggcgcggatttttccggtggcggtgggcaagatgctgacgcagacgccgaccggcagcttcgacatcaccggcatttacaaggcgccggcgtggcatgtgcccaagtccatccaggatgaaatgcgccgcaacggcaaggaagtgcagaccgtggtgccgccggggcccaacaatcccttggggccggtattcgtgcgctttggcgaaagccggctggggctgggctttcacggcaccaacgctcccggctcggtgccgggttttcgcagccacggctgcgtgcggctgaaaaacgacgacgcgctggagctggccggcacggtcagccgcggcgacgcggtcaccgtcgcctatcagaccattctgctgagccaggatgaagccggccagttgtggctgaccgtctaccgcaaccattacaagcaggaagatccgtcgctgaaatacctggcgcagacgctgctggactggcagcgccagcaccagcaggcgctgtacggccagcgggtggacgatgcgctgaagcagcgcagcggcaagccggtgtgcttgagctgcaagagcgccagcggcgcgatcagcggcggcttgcagccttttgcctggctgtcgcgcctgacgccggccgccgcgcccgagacgccggcggccagccagccggcgccggatcgcgagccgggtccgccggccagggccagccagcgcggcagaaccgccgcccgggccggttgatagggttttcggacgaaaaaggccgctttcgcggccttttttcttgctcgccgtttactgcgcggcggctttcagcgcctggccgatgtcggccaggatgtcgtctatgtgttcaatgccgatggacagccgcaccagctccggcttgacgcccgcgctcagctgttcttgcggcgacagctggcggtgggtggtggaggccgggtggcaggccagcgacttggcgtcgccgatgttcaccagccgcgtcaccagctgcagcgcgtcgatgaagcggccgccggcggcttccccgcccttgatgccgaaggacaggatgccggaggcgcggccgcccaggtagcggtccaccagcggcttgcttgggttgtcgggcagaccggcgtattccacccactccaccgccgggcttgcttgcaggaaatgggcgactttcagcgcgttgtcgcaaatgcggtccagccgcagcgccagcgtttctatgccttgcaggatcaggaaggcgttgaacggcgacagcgccgcgcccatattgcgcagcggcaccacgcgggcgcgggcgatgtaggcggccgcgcccagcgcttccacgtaattgacgccgtggtagctgacatcgggctcgttcagccgcttgaagcgcgccttgtgctctccccacgggaatttgccggagtcgacgatggcgccgcctatgctgttgccgtggccgcccaggtatttggtcaggctgtgcacgacgatgtcggcgccgtgttcgaacggccggcacagatagggcgaaggcacggtgttgtcgacgatcagcggcaggccgtggcgatgggcctcggcggcgaaggcggcgaaatccaccacattgcccagcgggttgcctatcgattcgcagaacaccgccttggtgcgttcgtccaccaaagcggcgatggcggccggattctggtagtcgacgaaacgcacttcaatccccagctgcgggaaggtgtgggcgaacaggttataggtgccgccgtacagcgtgcgggtggctatgatgttgtcgccggcttcggcgatggtctggatggcgtaggcgatggccgccatgccggacgccaccgccagcgcgcctatgccgccctccagcgccgccacccgtttttccagcacgtcggtggtcgggttcatgatgcgggtgtagatattgccctgcaccttgaggtcgaacagatcggcgccgtgctgggtgctgtcgaaggcgtagctggtggtttgatacagcggcaccgccaccgccttggtggtggggtcggggctgtatccggcgtggacggctagggtttccagtttcatcgtcaggctccagggcgggtcatcgggtcaagcgcttgtcatgatcgcctaccttaatgcctggcctgctcaatcgcaaggtgctaacgatgcttcaaaatataactatccgttatatttcagtccctatccgccagatcggctgccagttctccgacccgcgccagcgcgcgctggtaggcctcgttccacggatagcagcaggacagccgcaggcagttgcgatagcggcccttggccgagtacatcgcgccgggcaccacggtgatgcgttcggccagcgcggcctggaacagctgcatggtgtcggcgtggctgggcagctccacccacagcaggcagccgccagagggcagcgtggcgcgggtgccggcggggaagtgctgggccaccgcgccgcgcagcttttccatctggctgttgaagtggcggcggatcagccgcaggtggtggtcgtagccgccgctttccaggtattcggccagcgtttcctccaatagcgccggctggcccaggctgctggaaaacttcagccgccgcacttcgctgaggaagcggccgggggcgatccagccgatgcggaaacccggcgccagcgtcttgctgtagctggcgcatagcagcacccagccgtcgcggtcgtaggctttcaccgcgtttggcgtcgcggcgccgtaaaacaggtcggcgtgcggcacgtcctcgatcagcggcacctggtagtcgttgaccagttgcgccagccgctgcttggcttccggcggcatggtgctgcccagcgggttgtgcacggtgggcatggccaccacggcgttgagccgtttttccgacagcagcagttccagcgcgtccagcgccagcccgctggtggggtgggtggggatttcgatcacgctcagccccaagtccttcagcatgggcagcagcgcgaaataggtgggggactccacgcccacggtgtcgcctggcttgcaggtggcgcgcaatgccagctgcagcgcctcggtgcagccgttgctgatcaccagctcgtcggcggccagcacgcagccccaactgacggcgcgctgggcgatctgccgccgcagccgttccgagccgggcgggaacgggtagtcggtggtcagttccgggtgctggcgcagcagcctccccatgatgtgcttgaagcgggtggtagggtagaagtcgctgccgcgcgggctggccagcgacaggtcgatgaagtcggcctggttttgcgcgcccatcacggcctcgatctggtctaccacctcgccggtgtgatgggcggcgctctggcggcgcatccgcggcaagggcaggctggcggcggatttgacgtagaagcccgactgcggccgcgcctcgatcaggccgcggtcttccagcgtgcggtaggtctgcagaatggtggacgggctgaccttgtgcatcgcgcaggccttgcgcaccgaaggcagccgctcgcccgggcggatggtgccggtctggatcagggtggtccattcgttgaccagttgctggtaaagcggttcgctgctcatgttggaaggctccggacggggacggacggtacagtttcgaacgaaattaaccataacagttttgcaactgcaaaactgttatggtctcaattgtatttttctgaatctgtaattgtccagggcaaaagcttaagatgacggccttgagtcggggcgcgccccgagagtgccggcggcgcgccggctgcggtctaggagtcgtcatgaatctgcttgcactggtcacctatctgctggtgatgtccatcacccccggccccaataatctggtgctggcgtcgtcgggggtcaatttcggtttttcgcgcacgctgccgtcgctgctgggcatggcgctgggcctgtcgctgcaggtaggcatcctctctgtcggtttgggcgcgctgatgtcgctgatggagtcgctgcagctgtatctggcgatcgccggctgcggctacctgctgtggctgtcgtggagcatggcgcgcgcgggggcggccaagagcgccgacgccggcgtccggccgatgggcttctggggcggcatcctgttcaactggctcaatcccaaggtgtggctgatgggcttcaacctggtgatggtgttcctgccggcgcacatgaatccgtggcacgccgccgcgctgttcgcgctgatcacctttttcaccagcctgccgtgcatcgcggtgtgggccggctccggcgtggccatccgacgtttcctcgattccccgccgcggctgcgcgcgttcaacttcagcatggccgcgatgctggcgctgaccgccttctggctgctggcgcagatgatgccgagcggggccttgcccaatatggtctgagccggccaaaaagaagcccgcaagtttgcgggcttttttgttggcggcgtacaatggcgcccttgtgtgtttttctcagagtccaacccatcatgatccgtacccgtttcgcccccagccccaccggttacctgcacatcggcggcgtgcgcaccgcgctgttctcctgggcctatgcccgcaaaaacaacggcgtgttcgtgctgcgcatcgaagacaccgatctggagcgctccacgccggagtcggtgaaggcgattctggacggcatgcactgggtgggcctggactacgatgaaggcccgttctaccagacccatcgcttcgaccgctacaaggaagtgatccagcagctgctggcctccggccacgcctaccactgctattgcagcaaggaagagctggaagcgatgcgcgccgagcaggaagcccgcggcgacaagccgcgctacgaccgccgctggcgcccggaagccggcaaaacgctgccggccatcccggagggcgtgcagccggtggtgcgcttcaagacgccgctcgctggcgtggtggcctgggacgacgcggtcaagggccgcatcgaaatctccaatgaagagctggacgacctgatcatcgcccgtcccgacggcagccccacctataacttctgcgtggtggtggacgactgggacatgcagatcacccacgtgatccgcggcgacgaccacgtcaacaacaccccgcgccagatcaatattctcaaggcgctgaacgcgccgctgccagtgtacggccacctgccgatgatcctgaatgaagacggccagaagatgtccaagcgccgcgacgcggtcagcgtggtggactacgccgacaagggcatcctgccggaagcgctgctgaactacctggcgcgcctgggctggggccatggcgacgacgaattcttcagcatggagcagttcgtcgaatggttcacgctggaggcggtgagcccgtccgccagccgcttcaaccaggaaaaattcatgtggctgaacgcgcagcacatcaaggccgccgacaacggccgcctggccgagctgatcgcgccgcgcctggcgaaagccggcgtcgataccacccatggcccggccatcggcgacgtgctggcgctggtgaaggagcgggtgcaggacctgaacgcgctggcgctggaagtcgattacttctacaaaaagcgcgaaccggtcgccgccgatgtggagaagcatctggccggagacgctgtagcgcgcatgggccgcttcgtcgaccgactggctgctctggaagcctggagcgccgaatccatccatgagctgttcaaaccgttctgcgccgacgaaggcatcaagatgggccagctgggcatgccgctgcgcgtgctggtatgcggcaccacccagaccccgtcggtggacgcggtgctggccttgatcggcaaggacgaggtgctgcgccgcctgcgcggctgaccctttccgccgcacggcaggaaaccacccccgccgcccgcatgggccgcgggggttttcgcgtttgtcagccggccgccagtttcgccaggtagcgcaggccactgatgctggggaagaagcaataggcgctgccgcgggtgtggatcagccggggaaagccggtgatccgtttgttgttctgccccttggggccggcctgggcatcggtgaaggagctttggtcgaccgggttgacgccgatgaacacgtcctccccgctgatgttgaacaccgcgttgccttgttccggcccgcccggtccggtggccgatttgacgaagtcggagcgcagcacccactggctggtgacgaactcgaactggttggcgatgctggcattgatgaaatagccgatcaggccgcgcttttgcgcgtccggcttggccgggtcgtattccgggccgtatggcatggcgcggcgcacgatgcggtgcagcgggctgccggcgcccaccaccgcgccgtcgcgcggattgctgcggcggatgtgcgagcctatcgggcacttcaggcccagcgtatcgtccttgtccagcgtggcgtcgacgtaatggaagtcgttcagctgcgagggcggcaagacctcgccggccgcgtcgggacgcaaggtcagcgggttgccgttgcgccagcggccgcagactttcgccgccagcgtttcggcatcgactcccaggcggggagcgtaggtttgcagaaagctttcgaagccttccacatcctgctccaggatgcggaaggcggcgaagctgctgttgagcgacagttctttcggctccagcgtgtagctgccgccgctttcgttgggataacccagcaggaattcgccggtggccaccggcggttgatcgtccgggatgtcgcgcttgcgcggcggcgcgccgatgatggtgggctgagcgatgctgtcgcgatagccgaagtgcactttgttatccggcagtgccacggcgtcttgcgccgacaatttcttcacgccgtaatcggcgaaggcgcagcatagcttggcgctggccgactccagctgttctgcagacccatccacccataggctgagcagcgcatggacttgggcgccctgatccaggccgcctatccagtgctgcggcgcgctgtcgccagtgtcgccgatgctggcggcgatgccgggatcggtcgcgccctggcggaaagacgcgtcgaaggtttgcagctgcgcatcgctcagtcccagccgcgccaggccggcgcaggtgaagctgagattgaggaagtggatgggtttttgcgcgccgcgttgggcggtggtgatggggggcaaccccagttcgccgtccaccagcttgagtatcagcgccgccgcgcgggctttgtcgtcgatgcgcaggatgaagtggcgggcgcgttccacccggtagccgcgcagaatggtgccctgcacgtcgtcgtaggcaatggctggggtcatgcggcagctcctagggggcgggatgcgggcggccgccgctggcgcgggtgggccgcttggtccgggcaatgttcagggcagcgaggccagcacctgctgcacggtggcggtgtaggcctggtacatgtcattgttgggggcgtgctgcgaggcgtcgttggcggcgatgaaggccttgaacgcggcgacgtggctggcgaccggaatcaggccggaggcgccgtcgatgaagcgcagcaaggcgtcgaagatggggccgacttccttgacgaagtcctggatgtagctgtcgaagctgccgtcgtattcggtgatcaccgccagcacgtagcttttgctgggcttgatgccgggctggagattgggcgcggcgcggtccagcaactgggtgcgggcgtagtggacggtgccgatcttggtcagcgccgcgtgcagcagcggctggttttccttcacggtggcggccagggcggtcaggtccgcgtcgggcgccaccggcatcagcagggtaaggggactggccatgtttctctcctaaacgcaactatcggaggttgaaacataggaagcggacagccggttggtaattgtgttgaatacgtagcgccggctgcggtcagcgccgcagcagctgccagctggcgatgccggccatggtcatcagcagggagccgctgacatgcgcggcgatggcggtgaaggcgggaaccagttgcccctggcgcagcagttccaccacttcggcggaaaaagtggaaaaggtggtcaggccgccgcagaagccggtgatgatcagcagccgccacatcggcggcaggctgggcatgtcggcgaacagcgccaccgccaggccgatgatgtagccgcctatcaggttggcggccagcgtgcccagcggcagggaggggaacaggctgttcagccgcaggccgagaaaccagcgcagcagcgcgccgatggcggcgccggcggcgatggcgaatatcgatttccacatggtgacgagggcgggagtggcgatgccagccattctgcatggcgcggcagctttcgtacagggagcggccgggcgaaaaaaaagagccccacagggggctcccaattgcaccttcgctcaggtgaccagactgcgcgccgttgacgacgcaatccgatcgcgtccggtccgctcatcccttgggtttcgcgaactgacgaggtgattatcccggcagggccggcggcgctgtagcatgattgttgagcgcttatgtgacggggtgtaatgaaatccggctggaattaacacttccgcaaaacaatcgcctggaatgcccagaggcagacgcgtcaggcaatttgccgttattatccggagatcatcggggagcaaaggaccagattttgactacgcattatccggtaatagacaagcgcaccatcagcatgcgctggggcgatatggacgccgtcggccatctgaacaacacctactatttccgctatctggagcaggtgcggatagagtggctgaattcgctgggctacggcatcgacccggaaggcatcgggccggtgctggccaataccgcctgcaccttccgcaagcaactgacctacccggcgacgctggacatcaccatcgaactggaaaaactggggaacagcagcctgaagctgcgccaccacttctaccggcaggacgaccccggcacggtttacgccagcgccgaggtgctgctggtatgggtcgattacaaggcggaaaagtcggtcgccattcccgaccccatccgcgaagccatccagcgcgcgctgccggcggcgtgattcgtcacgcggccggatccagcttgcggcggatcaggtcgcgcagcaggaagcggctgggatggatggcctgcatcaggtgggccggcagcggcgtcggttcgtcttccagcagcgccgccaggatctcgcccgacagcggcgcggtgatcagcccgcgcgagccgtgcgcggtgttgacgtacaggccttccacccatgggcaaggttgctgcggctgcaaggacgcatcccgggcgagttcggcgtagcattgcgcgaagtcgcggcgggcgacggccgggccgatcagcggcaggtagtccgggctggtgcagcggaaggcggcgcggccatccagcgcgccgcggccgccgctggtcaggccgtcatgcaattgcggcgccagctcggccagcatctgcaggttttccgcatgttcggcgtcgtttaccgccaggtcgtcgctgtcgaacttgaaggtggcgcccaggcaatggcggccgccgcgcgccggcgagatatagccttcgccgcacagcacggtggccagccgctcgctgtccggcgtcgcggcgatgctggtgacctggccgcgtatctttttcaagggcagatggctggtggcgtcgaactgggcggtttccgccgcgcccgccagcaccaccaccgaggccagggccagcgggccgctttcgtcgctggccagccaatggcgctcgttctggtcatactccagctccagcacggtatggctggtgcgcacggcgatattggggtggtcggccagccgcgccaccagggccggcggatgcacccagccgccctgcgggaagaacagcccgcctgagggcagcgccacgccagccagctcgctggcctgctcgcggtccagcttgcgcatcaccgcttccggcagccccagttccgccagcgcctgctgtttttccccttccttcgcttcatgcgccagctgcagcacgccgcaggcgcgccagttttcgccatcctccggcagcagttcgcgcagggtccgcaggctgtacgcgtagccggacagcaccaggcgcgacagcggcgtcaggtgcggcgacagcttggtgtacagcacgccctgcgggttgccggaggcggcgctggcaagccggggcatccgttcgatcagcgtcacctgccagccgcgcacggccaggctgtgcgcggtggacgcgccggcgacgccgccgcccaccacgatggcgctgcgttcgcgccagcgctgcggcgggcgggcgaaccagggggcttgccagggcatcgcggcggcggtttgcagccagccgcggctgatatggcgtttctggccgtggccgggggctttttccacctggaagccggccgcggtcaggccgcggcgcacggcgccggcgctggtgaaggtggcgaaagtggcgccaggggcggacagacgggccatctggtcgaacagcggctgctgccacatgtcgggatttttcgacggcgcgaagccgtcgaggaaccaggcgtcgacgcgggcgtccagctgcggcagcacgtccagcacgtcccccaccatcagcgtcaggctgacgcggccgccggccagcagcaggcggtgccagcccggcgtcagcatgtcgtattggcgcagcagctggttggactgcgccgccagctccggccacagcgccagcgcgcgggacaggtcctgcggggtcagcgggtatttctcggcgctgacgaaatgcagccgggcgtcggcgggcgcgtgctgctcaaagcattgccaggcgcagaggaaattcaggccggtgccgaagccggtttcggcgatggtgaattgcccgcgctgcggcagggcggcgaagcgctcggccagctggttgtgctggaggaaaacgtggcgggtttcgtcgaggccggcgtcgcgggaaaaatacacgtcgccgaaggcgatggacgtaggttggccatcctgccagtctagctgggcaggcgtggaaatgcgtggggtgcttgggcttgtcattgcggctgggcccgcggccggcgggctggcggattctgttctgtcagcctggattgtcgcacggccaatacagccgttccagatggatggcgcgcaaacgccgccgcttgtcgttatctaatgcttgggaatgtattttgcgcatttaaatgccaatgaactcatcgcgctgccatgggtgtcgagaccggcgctgccgagcgcctggcttgtaataagatgaggaagggggcgtcggcggatgggcggccatggaaggttctgcagggcggaggcgtggaagatgaggcgagcgagcagcataggcagtcggctggtattgacccaggtagtgctgatggcgctggtggccggcgcgatcctgtatcccttgtatgtgttcagccagcgcttgatgctggagcgcacccagaaagtgcaggcccagctgctggcgcagtcgctgaacatggtggacggtttcaacgaatcgttgcgcctgtccacccggcaattcgagaaagtgttcttcgccgagttcaggagcggtttcagcctgaatccggcagagaagatcaatgtggccggcgcggcgacgccggcgttgttgatgggcggcgagccggtcaacggcaataaccggatggtcgaccacttttccgcggtcagcggcaatgtcgcgtccatcttcgtccgcgacggagacgacttcgtgcgcgtgtccaccacgctgctgatggaaaacggcaaccgcgcgctgggcagccggctggagcgcgccgcgccggcttacgccaagctggccgccggcgacggctacatcggcctggccaatctgtacggcaaggattacgtcaccagctacagcccgatcaaggacggcgacggcaaggtgataggcgccaccttcgtcggcgtcggcgccaccgagggtatcgccagcctgctggtgcggctgggcaaggtgaagctggaggatagcggccacatcgacgtgatcgatgtcaatccggcttcggccagtttcggccgctatctgctgcatccgcggctgaacggccgttcggtggacaaatcgctggacgccgacggcaagccctatctgcgcgaactgctcaagggcggcagcggcaatctgtcggtgcgcctgcccggcgacaagggcgccgccgcgcacatgctgtcctacgccagcttcgcgccgtggaactggctgctggtcagcgacgaaaccgagtccgagctgcagcgcgaaaaccgcatgctgatcgcctggctggccgccggctgcggcgtgctgctggcggtgctggcgctggcgttgtggggcgcgacccgcatcctggtgacgcgtccggtgcgccaactggtggccgaggtggcgtccattcaggacaaccatgatctgcagcgccgcctgccgacggggcggggcggcgagatgggcgaaatggccaatgcgttgaacggcctgctggacagcttccagctggcgctcaaccgcaccagccatcacgcgctggacctggaccgggcggcgcaggatctgtcgcacaaggccggcgcggcggcggcttcgtcgggcgagcagcgcgacagcgcccggcagatgtcgcagcacaccgagctgctgatcgccggggtggagcagatcgaaagggtggcgggcgaggccagcgaggtggcgcaggcgtccagcgaagcggcgcagaacggcagcgccagcctggcggcggcggtggacgaggtcaatcgcatcgccgcgacgctggacaacgccgccgacagcctgctggcgctggagagcaacgccggccagatcagcgacatcgtcaacgtgatccacgacatcgccgaccagaccaatctattggccttgaacgcggcgatagaggcggcgcgcgccggcgagatgggccgcggcttcgcggtggtggcggacgaagtgcgcaagctggccgagcgcaccagccagtccacccggcagataggcgaaatgatcgccgcgatgcagcaggcggcgacgctggcggcgcaggcgatgcgccagtcggtgagctgcgcgtctgaaggggcggccatcaccgccagggcgcgggaggcgatggggtccatcgtcgccgacgccgaacgttcgatggcggtggtgtccgccatcaaccaggagctggcgtcgcagcggcagaccgtggaaaacatcgcggaacaggtggcgcaggtggcccggttggccgaaacccacaatcaggaagccgagcgttcggcgcaaaccgccggcgaaatggcgcagctggccgactcgctgaagcaggaagtgcgggtgttccgcgcttgattcccggcagccgccgggtttgcgcgcggtcaaacgccggcgcggcggcgcccttgaaatggccggcaggctccccaagatggaagtcatcgacagttttcacgggagccgcaaatcatgcgattcgacaagctgaccaccaaattccaacaggcgctgggcgacgcccaaagcctggccgtagcgggcgacaacgcctatatcgagccgcagcatctgctgctggcgatgctggacgacgccgaagccggcgtcggcggcctgctggcgcgcgccggcgtcaacgtgccggcgctgaaggccggcctgaagtctgccatcgaacggctaccgcgggtgcagggccatggcggcgagatcaccgtgtcgcgcgatctggccaatctgctcaacgccgccgacaagatcgcgatgaagctgggcgacgaattcatcgccagcgagctgttcctgtccgcgctgagccaggacaagggcgagaccggccgcctgctgaaagagcacggcggcaaccacgcgtcgatccaggcggcgatagacgcggtacgcggcggcgagaacgtcaacagcgccgacgccgagggccagcgcgaagccttgaagaaatatacgatggacctgaccgagcgcgcccgccagggcaagctcgacccggtgataggccgcgacgacgaaatccgccgcgccatccaggtgctgcaacgccgcaccaagaacaatccggtgctgatcggagagccgggcgtgggcaaaaccgccatcgtcgaaggcctggcgcagcgcatcgtcaacggcgaagtgccggaaagcctgaagaacaagcgcctgttggtgctggacctggcggccttgatcgccggcgccaagttccgcggcgaattcgaagaacgactgaaggcggtgctgaacgatctggccaaagacgacggccagaccctgatcttcatcgacgaaatccacacgctggtgggcgccggcaaggccgaaggcgcgatggacgccggcaatatgctgaaaccggctttggcgcgcggcgaactgcattgcatcggcgccaccacgctggacgaataccgcaagtacatcgagaaggacgccgcgctggagcgccgcttccagaaggtgttggtgggcgagccatcggtcgaggacaccatcgccatcctgcgcggcctgcaggaaaagtatgaaatccaccacggcgtcgacatcaccgacccggccatcgtcgccgccgcggaattgagccagcgctacatcaccgaccgcttcctgccggacaaggcgatagacctgatcgacgaggccgcatccaagatcaagatggagctggattctaagccggaagcgatggacaagctcgaccgccgcctgatccagctgaagatcgagcgcgaggcggtgaagcgcgagagcgacgaggcttcgcaaaagcgtctgcagctgatcgaggacgagataagcggcctatcgcgcgaatacgccgacctggaagagatctggaaggcggaaaaagccgcccagcaaggctcgcagagcatcaaggaggaaatcgaccgcctgaaggcgaatatggaagacctcaagcgcaagggcgactggcagaaactggccgagttgcaatacggcaagttgccgcaactggaagcgcgcttgaaggaggccgaggccgccggcgagcagggcgaggccaagcccaaccgtctgctgcgcacccaggtgggcgccgaggaaatcgccgaggtgatcagccgcgccaccggcattccggtgtccaagatgctgaccggcgagcgcgagaagctgttgcacatggaagacgtgctgcatcggcgcgtggtggggcaggacgaggcggtgaccgcggtggccgacgccatccgccgctcgcgctcgggtctggccgacccgaacaagccgtatggatcattcctgttcctgggaccgaccggcgtcggcaagaccgagctgtgcaaaacgctggccggcttcctgttcgacagcgaggagcacctgatccgcatcgacatgtccgagtacatggagaagcattccgtcgcccggctgatcggcgcgcctccgggctacgtcggctacgaggagggcggctacctgaccgagcaggtgcgccgcaagccgtacagcgtgatcctgctggacgaggtggagaaggcgcatccggacgtgttcaacgtgctgctgcaagtgctggacgacggccggttgaccgatggccagggccgcaccgtggacttcaagaacacggtgatcgtgatgacgtccaatatcggcagccagcagatccaggcgatggccaccgacgattaccaggtgatcaagctcgccgtgatggccgaggtgaagacccagttccgcccggaattcatcaaccgcatcgacgaggtggtggtgttccacggcctggacgagaagcacatccagtccatcgcccgcatccagctgaagggcctggaggcgcggctggccaaactggacctgaacctgcagatcagcggcgaggcgctggcgctgctgtccgaggccggtttcgacccggtttacggcgcgcgtccgctgaaacgggctatccaggccgaactggaaaatccgctggccaaggcgattctggccggcaagtacccgcccaagtccacggtgctggtggaggcgaaaaacggccagctggttttcgactgaccgtcgccgctgcgcgcgaaaacggccgctgttcgcagcggccgtttttcatgggcgggcgctcaggcgtcgccgtgcgggtgcaggaagcagccggccaggtggtcgttgaccacgccgcaggcctgcaggtaggcatagactaccgtgctgccgacgaaattcatcccggctttcttcaactccttgctgatatggtccgacagctcggtgctggccggcacccgttcgtcgtcgcggcggcgcagaatcggctggccgtccacgtgcccccacagccagtcggcgaagctgccgtgttcccgctgcatttgcaggaacactttggcgttgcggatggcgctgcggattttcagccggttgcgcacgatgccgggattctgcatcagccgttcgacgtcgtcctcgtccatcgccgccaccttttccgggtggaagccgtggaaggcggcgcgatagccttcgcgcttccgcaagatggtgatccaggacagcccggcctgcgcgccttccagaatcagcatttcgaacaatttgcggtcgtcgcgctcgggccggccccattcctggtcgtggtaggcgacgtacagcgcatcgtcgccgcaccaggcgcagcgttgggtctcgttcatggcgtatgcagcaggatgtcgatcttgaggccggttttctggatgccgcgctgggacgacaggctgaccaccagcggattgcagaggttggcctgcagctggcccagcgccgggtgggaatcgcgctcggtttccagcgggcggtacagcatcagcaggatggcggcgtcctccgggccgcgcagttgcagctgcgccacttcgtcgtcggtgagctccacctggaagcggacgcccagccgctcgggcagcgccaggctgaaagtgatgcccgggtcgtccagcgactgcagccaatagacctgcggcgttttgtgggcggcgtcgtggaacaatttgaagcgcgtgcagttctccagggccggaatgccgtggggaaaggtgaggatggtctgttcgtccacctctacgttgccaagctggccggaatcgaaacgcatggggttctccttgcggaatgggtgtcgcggccgaccatgataccgcagcggcggcgcatggcataaaccggcgccgcgagcgcgcggccggccggcaaggccgtcttgtactgccaaatttgtcagcctatacatggtattacgctgtctggtcttacgcgaatgtcttagttttggagccggccctcggtggggaagccggcgcgcccagatggttttccgcagcgcttaatttcggtaaggcggcatttccggcgagctgtgctgcaaggccggttctgccatgcctgggaaggggcggtctagcatggagctgaaaccgaagcgttttttgattctggacgatcagctggtattgcggaagctgatctcgcgccaggccagcttcttcagccgtttcgcggtggagatagacgaattcagcgacccggccgaggcgctgcgcagcatcgccgaaggcggctaccagctggtcatcaccgatatcggcatgccgggcatgaacggcatcgatttcatcaagaatgtggccaggctgggctaccagtccgccttgctgatcatctccggctatgacggcaaaaccctgcagaccatcgccgacatgtcggccaatctgggcatctcctgcacccgcttcctggccaagccgtattcggccgaggcattcgtcgccatgttgaacggcattttcaatgaaatggagcgcgccgaggcgccggcgcaactggatatcgagccgctgctggccgatatctgcgacgaccgcttcgcgctggagttcgttcccgtggtgacgctggccgaccgccgcccggtcagcttttcgctgcgcgcgctggcgttgggcgagaggcgctgcggcatcgatcatctgctgccgctgctggcgggccggcgcatggcgtcggcggtggccctggaaacgatagtggagcggatggccaagctattgcagggcatttcgctggcgtcgggccaggacgagtgccagatgcacatccgcatcgacgaggcgtgcctgtgcgccgacaacgtgttcgaccactgtttcaccctggtgcagcaatacggcgtcgcgccgcgccgggtgagcttcgagctggcggacggcttgagccggcgctccgacgcgctgtgcttcgagaacatcgccaagatcaagtacctggggtttcatctgacggcggacgcgttcggcatcggctcgctgaccatcggcaacctgctcaagtttccgttcgaccaggtcaatgtgccggtggaaaccctgcactggctgaaaaccctgcagggcgaagatccgcacacctttcgtctgttgcgtcatttcggcttgtcgcagaccgcggtttgcgccacccgggtggatgacgaggagggcagggagctggcgctggcgatggggtgcgtcaagggagtgggggatgggctggccggcgtcgtcgcggagcaggatctggccaggctcatcgtggactgccagggcgaccgggcagcctcaagcggaaccatagtgtaaaggatgcgcgatgatttcggtcgacctggcgcggttgcggatcatgatcgtcgatgaccagacgctggtcaggaccctgatatcccaggccttgcagaacatgggggtcaagtcggactatatcttccaggccgccgacggcaccacggcgatgcggctgctggatatccgcatggtggacatcgtgctgtgcgatgtgcagatgctgccgatgaacggcatggatctgctgaaggagctgcgttgcgggcataccgccaacgtctccaatctgcccttcgtctttctgtccggccacgccgaccgctccaacgtggtgctggccagccagctgcacgccgacggtttcgtggtgaagccgccgaagcccgccgacgtggagaaggcgatccaggccgcgatgcaccggcccaggccggagatcgatccattcagctactacaacatcgcgaccggcaccgactacgacaacaaagtgttcggcaagctgttcgaaacccgggcgccggtgtatcaggaagagccggcggagcaatgcctgccgctggacaagatcaagccgggctcctatctgacgcgcgacttgcgcagcaaggccggccatttgctgctgccgcgcggcgccaccatttcggccaaccagctggcggtgctgaaagacttcagcgagcgctacggcgtggcgcagattttcgtcaccgaaagcctggacgcggtggcgagctcttccgcggcaaggcattagcatgctgcaacccaaggcgcgccatagccaggcgatggcgataggccggagcgtgctggccattgtgctgctgctgggcattctgcaggccggcgtgatggtccagctgcaggtgacggcctggagcgaataccggcaggccgaccggctggtggagctgaatcaggacagcagcctgttgtatcgcttctccgatatccagcatcaggaaagcggccagctgcgggcgctgttgctgggacggcagccggacgccgcgaccctggcagccttggaccggctgtctcggctggtggacgagcgcttcctcgccatggtcacttcgctgcatggccgcgacgaagcgcggaccagcgagaagatcgcccggctgcagcagctattccgccagtatcaacagctgcgggtgcaggccaaggcggtgtggcagtcgagctccggcccgaacgaggcgctgaccaccagcctgtacgagcagacccgcgacgtgcaggagcaggtgcagcatctggtggacgactccgtggtgcagatggcggccagcggcgacgccaggatcaacgacttggcctggctgacgcaggatgtgtggatactggactactggctgcgctccaatgcgcaggcgctggtgctgcgcgcggagctggaccaccggctggatcgtaggatggaggaggatctggcgcggcggctggcggccggcatgctgacgctgggcaagctccagcccagagtcgacagcgtgcgggatgtcaggctggctcagcagttcatccagctgacccgtcttgccagcaagctgcagctgttggcgcagctgcagctggaacagttggacggcaggctgaagttcagccaggccgccgactacccgctcaatctgcggcagctgacctcggcgttgcagcagttgcaggcgatggtttccgcgcgggcggaggcgctggccacggaaaaccgccagtactatctgcacattctgctgcgcgagggggcgtttggcctggcggcgatggcgctgctggtgttcctgctgtacgtgatggtgcgcaaggtgctcaagccgctggatttcctgcagcgcatgctggacatctccggcgacgcgatgctggtggtcaatcaggacggagtgatagagatcgccaacgagggcgcggggcggatgttcggctacccgctcgccgccttggtgggcatgccggcgcggcaattgttcgtgatgaacgacgagatgcacggcgtgatggcggcgctggagctgcaggtgggacggacgctgccggtggagggcatgggcagcggcggcgagcatttccatgcgatgctcaacatcagccgtttttccggggaatctgacccgccgctgaatatcctgatcgtgcgcgacgagcacaagcgcaggctggcggaaagctcgctggagcgcagcgtggcgctgctgtcggtgatttcggaaatcgaggcgatgctgctagcccgttcggcgcgggatgcggtgttccagcgcctgcacgacactttcgtcgagttcaccagctccgaagagtgcatgctggtggcctggtcggcccaggacggcggcgacgaggcattgcagctgcaagccggtgagtggcctgagttcctgccgctgatccagcaactgtcgcaggcggaaatgccgctggcggcgctgttccgcagcttgtcggcgcagccttcctgggtatcgctgccggtgatgctgggtggcgaggccaccgctggcgtctgcctgctgcggcccactttgtcgcagctgggcatcagcatcctgccgctattgggcgcctacgccaatattctcggtttctacgccgaagaagaccggcgcaagctctccgaagcccagctgcgggcggtgctgcaggaggaggaggcggtttattcggcgtcgccggtcggcctgctgcggctgaacgagcatttccagatcacccgggccaacctcaccgcggaaagcatcttcgatgtgggcgacgagtacggcctgtccgggatgcatctgatggagctgctggcttccgagcatggctggtatgagctggccgagcaaatgtcgaagatgcagcacgacaatgcccgcatccattgcgaactggaatgcctgaccggcaccggccggccgatctgggtgctgttcgaaggccagttgctgttcccggacgcgtccgaatcggtgatcatcctggcctgcctcgacatcaccgaacgcaagatggcggaattcgaactgcgcatggcgcgcgaccaggccaacgcggccaaccgcgccaagagcgccttcctggccaccatgagccatgagatccgcacgccgatgaacggcgtgctgggcatgctggaattgctggcgatgaccaagctggacgccgagcagagcgataccgtgctcaccattcaggactcggccaacaccctgttgcgcctgatcgacgatatcctggatttctccaagatcgaggccgaccggctggagatcgtgcccacccgcaccgcggtgcgccccttcatggaaagcgtgcgcagcctgtaccacgagaacgccagcaagaagggcctggacctgtcgctgacgctggacgaaaaactggcgcccaccctggtgctggacccgctgcgggtgcggcagatcctgcagaacttcatcagcaacgccatcaagttcacctcgcgcgggcgggtggacatccgcgtgaaggtgatggacaccctggccaattaccaggtgctgagcttcgaagtggccgataccggcatcggcatgtcgcaggaacagctgggcaaactgttccagccgttcacccaggcggattcggaaaccacccggcgcttcggcggcaccggtttggggctggcgatctgccgccgcttggccggcctgatgggcggccacgtggaaatggagagcgagcagggcaagggcagctgcgcccgcttgctgctggaagtggagtggctggccgagctggtggagccggtggtgctgccagagcagcgggtgccgctggagtcggtggcggcgctgtcgggcggcaacctggcggacgagggcgaggagctgttccccatcttgttcgccgaggacaaccccaccaatcgcaaactgacgctgaagcaactggaaaagctcggttatccggcggactgggccgaggacggcgaccgggcgttcagcaagtggctggccgggcggtattcgctgatcctgaccgattgccatatgccgggcatagacggctaccagttggccagactggtgcgcgcccacgaggagtcccatccggaacgcggacgcattcccatcgtcgcctgcaccgccaacgcggccaaggaggaggtggacaagacccgtgaggccggcatggacgatttcctcaccaagcctttgtccatccactcgctggaggcggtgctgcgcaaatggatgggccatggcggcgaggaagagatcgagccgctggcgcgggagctggctccgccgccgccgcccgagccggcgcaggatcccttgccggtggaccgcagcgtgctggaggtttacagcaatggcgaattgagcgtggagctggagattctgcgcgaattccagaccggcaatttggaggacgtggccgagctgcgagccgcgctgcaggcggaagacgctgatcgggtgggcttttccgcgcatcggatcaagggcgccagccgcatggtcggggccaacgagatgggcgcggcggccgaggcggtggaaaaggcgggcaaggcgcatgacctggagcaggcgcgccgcgcgatggcgctgttcgaggaaaagctggccgccttcgaaggctggctggccggccaggtggaaatcgccatgtgacaagccgccgggcttggcttgggacggcgcggcgctttagaatccgcagccatgaaccgccctcaatcgctataccctgcgctggagcaggcgctgctttgtccggacgtggaagagaagctggcgctggcggaggccgcccgccgcgactggctcgccggcgcgctgccccggctggacgcccccgcgccgtattccctgccggaagccggccgtcccgcccggcccgaactggtgcacccggccaaggtgccgcgccgcggcctctccacgccccacggccacgccgctttgctgcacgccatcgcccacatcgaattcaacgcggtcaatctggcgctggacgccgcctggcgtttccgtgaaatgccggacgatttcgtcggcgactggctgcaggtggcggcggaggaagccaagcatttccggctgttgcagcgacggctgctggacctgggtttcgcctatggcgatttcccggcccacgatggcctgtgggcgatgagccgccgcaccgataacgacgcgttggcgcggatggcgctggtgccgcgggtgctggaagcgcgcggcctggatgtcacccccggcatccagcgccggctggcacgcatcggcgacgacgccagcgtggcggtgctggacgtcatcctgcgcgaggaagtggggcatgtgcggatcggcaaccgctggttctgcgagctgtgccggcaacgcggcctggaaccgcaagccgctttccgcggtctgttggaagcgtacgcgatgccgcatcggcccgggcagtacaatttggccgcccgcgaggcggcgggtttcttcgccgacgaattacaggcgctggccgcgctggacgacagctccgccgccatcgacaattgaatcccggaacaggacatgatgaatctgatcaagcgcatgcagcgcaaccgcaagctggctttggccgtgttgatactgtctactttgctgttcaccgccttgtcggccgcgtggcgcggcggagaggccggctcgatctggctgacgatcgcgtgcccggtgctgctgttgctggcgctggcggggcagctgagcgcgctgttggctttattgcaaaaaccacgaaaataaaacggcttttaaaaacagcggcttaaagtttcgcatgcgcggcggacatgcttgacgctgtccgcatcgccgcgcataatcgcgccggatattaaagaaacaggctcccctgtcgggtgggcctgtcgttttttgcactttcggagtgtctgcaccatggagcaccaggtattcctgcgccagctggaaagccattcgctgcctgcatcggatttcaatcaccaagcccacctgtacgcagcctgggggtatcgccgggagtacccggcgcccgaggcggcggcccgttgcgcccacgccttgtcgcgcttcgccatggcgaacggcgcggcgaccaagtacaaccacacgctgacgatggcgctgctggcgatcgcctacagccgcatcgagtccagcccggcgctgggcggcgactggccggcctttctcgattgctgcagcgatctggcgcaagacgcccgcgcggtactcgaacaatattattccgccgagcgcctgatggccgactccgcgcgcaaggccttcgtcaagcccgacaagcagcctttgcccgtgtcctgtctgctcaactaaaccgacaagccccaccgcaatgatcaaagctcccgaactgctgctgcccgccggcacgctggataaaatgcgcgccgcctacgactacggcgccgatgccgtctatgccggccagccgcgctacagcctgcgcgcccgcaacaacgacttcaagctggaagaactgaaaatcggcatcgacgaggcccatgcccgcggtaagcagtttttcgtcgccagcaacatcctgccgcacaacagcaagatcaagacctatatggccgacatggcgccggtgatcgagatgaagccggacgcgctgatcatggctgatccgggcctgatcatgatggtgcgcgaaaaatggccggaagtgccggtccatctgtcggtgcaggccaataccgtcaactacatgggcgtgaagttctggcagaagctgggcgtgtcgcgcatcatcctgtcgcgcgagctgagcctagacgagatcgccgagatccgccaggaatgcccggacatggaactggaagtgttcgtccacggcgccttgtgcatcgcctattccggccgctgcctgctgtccggctacttcaaccaccgcgatcccaaccagggcacctgtaccaacgcctgccgctgggactacaagatgcacgacacccagggcgacgacgccggcgatgtgcaggtgatccagttcgacttcaacaaggcgatggaagaggccaatcagagcttctcttcctgcggcagccagcagcgccatcctttggccgacaagacctatctgatcgaagaaggcagccgtccgggcgaactgatgcccatcatcgaggacgagcacggcacctacatcatgaactccaaggacctgcgcgctgtcgagcaggtggagaagctggtgaagataggcgtggattcgctgaagatcgaaggccgcaccaagagcctgtactacgtggcgcgcgccgcccaggtgtaccgtcaggcgatcgacgacgcggtggccggccgcccgttcgacctcaagctgctgtccgacctggatggcctggccaaccgcggctacaccccgggtttcctggagcgccatcagacccaggaataccagaactacctgaccggccactccaaggccaagcaaagccagtatgtcggcgatgtgatcgaagtggacgccgacggctgggcgctgatcgaggtgaagaaccgcttcggcgtcggtgacaggctggaggtgatccacccgtccggcaaccgcatcatcgaactggcggaaatgacccgcaacggcgagtcggtgcagcttgccgccggcaacggcatgcaggtgcgcatccccggcctgcagggctatgacagcaaggcgctgattacccgcctgatgtgagcggcgagcgtcgctgtacggaaaaggccgccgcgaggcggcctttttgtttggcgcgtcgccgcgggtgttgcgggatttccactggacggcgccagcggccggcggcggggtggcggagcgtttttctggagatgacaatgtcttgactggccgcccggccagcgcggcgccttggcgggctggcgcggctgaggtgttgatgatcctagacggcacgcgcggacatcggctgtcgtgtcgaattttttacccatgccgacgctgtcgctattgcaagcataagtaattgtgattaaaaagtagtgacataaagaaaagtggtgtggattttattaaacaccaatgccgtgcctggagatagagagaggaacccatgatgcaagcagcccacctgtggcccgcctgtccggcatcgcgccgcctcagcccgtccgcctcctttgccgcccgcgcctcccgccgccggcccagcccttccgactcttcctgaattcctgcccgatcgcgcgcatgccggatgcgatccggtttacatgccgtaacgcgccggcgatggcgcgctcctgcccagggtgtatgttggcagtagcgccggcgcggcgcgggcggtaggaaacaatgcggttctttgcttcccctgggttcgggggaagcgtctatggtcgtgcttacctaggaagcctgtcatgaagaagaaactgattcgcaaggttctgtattcgctgctgctgttgttgccagccgccggcgcgctggcggaggacaaggtgctgaatgtctacaactggtccgattacatcgccaagtccaccatccccggctttgaaaagcagaccgggatcaaggtgaaatacgatgtctacgacagcgacgacacgctgcaggccaagatgctgaccggccgcgccggctacgacatcgttgtgcccacctccaacttcatggccaagcagatcgaggccggcatctaccagaagctggacaagtccaagattcccaacctcgccaacctggacaaggcgctgatggccaagatcgtcgacgccgatccgggcaacgcccacggcgtgccctgggcctacggcaccgatggcctgggttacaacctgaccaaggtgaaggccgtcctcggcgccggcgcgccgctggacagctgggacatcctgttcgatcccaaatacctgtccaagctgaagggctgcggcgtgtcggtgctggaccaggccaacgacgttttcgccgtcacgctgcaccatctgggcaaggatcccaacagcaagaacccggccgactaccaggccgcgttcgaggcgctgaagaaaatccgcccctacatcacccagttcaattcctccggctacatcaacgacctggccaacggcgacatctgtctggcgctgggctggtccggcgacgtcaacatcgccaagcaccgcgccgccgaggccaagcgcagctatcagctggcctacgtgatccccaaatccggcgcgccgatctggttcgacgtgatggtgattccgaaggacgcgccgcacccggaggcggcgctggaatggatcaactacatcgaaacgccgcaggtgaacgccgccatcaccgacgaggtgttctacccgacggtgaacgccgcggcgcgcaagttcgtcaagcccgagatcgccaacgatcccaccatctatccgccggagtcggtgatgaaggcgctgttcctgctcaagccgctgccgccggacatcatgcgcctgcaaaaccgcctgtggacgcagctgaagaccggccgctaagccggctcccggccggatgacgccgtccggtcttgtctgtatcgcacaactatagtccgccgcccggcgccgccgggacggccggacagccgtgggacattgtccgcccgggccgggcggtctgatggtgtcggcgaagccgcttcgccgatggggacccaatgttcggacgcctcaggcgtcgtggtgccgccatgaaactacccgattcgaaatggttgccgtcgggcaggggggccgtgatttcggtgcctttcctgttcctgttcgtgttcttcctgctgcccttcctcttggtggtgggcattagcttctcccagcagcagctgggcattccgccgtacacgccgctggtcaagctggaaaacgacgtgtacacgatcgcgctcaatctgagccattaccgcttcatgttcaccgacgacctgtatttcgccacctatgtcagctcggtgaagatggctttcttctccacggtgctgtgtttgctgatcggctatccgatggcctattacatcgcccgggccgaaggcgcgacgcgcaacacgctgatgatgatggtgatgctgccgttctggacctcttacctgatccgcgtctacgcctggattggcattctgaagaacgacggctttctcaatcagttcctattgtggctgggggcgatagacagcccgctgcacctgtaccacaccaattggggcgtttacatcggcatggtgttctcctatctgccgttcatgatcatgccgctgtacgcccacttggtgaaaatggacctgacactgctggaggccgcctacgatctgggcgccaagccgtggcgcgcgttctggcaggtgactttgcccttgtccaaaaacggcatcatcgccggcagcctgctggtcttcatcccggcggtgggcgaatacgtgattccggagctgctgggcggatcggacacgctgatgataggccgggtgatgtgggacgagttcttcaacaatatggactggccgatggccgccaccgtcacttgctgcatggtgctgctgctgttggtgccgatggcgctgtttcagcattaccaggtgaagaccatggaggaagcaagatgatcaagccgagcaagccgctgtctttcctggtgctggggctgggttacggttttctctacctgcccatcgccttgctggtgatctattcgttcaacgaatccaagctggtgacgctgtggtccggcttttcgctgaagtggtacgccgccttgctggacgatgacgaactgatcaccgccgcctggctcagcctgaagatcgcgctgatgacggccaccgcctcggtggtgatcggcacctgggcgggtttcgttttgggccgtttcggccgctttcgctttttcaccctgttcaccggcatggtcaacgcgcccttggtgattcccgaggtgatccagggcatttcgctgctgctgctgtttgtggcgatggagcaaagcttcggctggccggagggcaggggagtgttcaccatctggatcggccacgtgatgctgtgcgtgtcctacgtcgccatcgtagtgcagtcgcgggtgcgggagttgaacctgtcgctggaggaggcggcgatggacctgggcgcgcggccgctgaaggtgttcttcgtcatcacgctgcccctgatctcgcaggcgctggtgtcgggctggctgctgtcgttcacgctgtcgctggacgacctggtgctgaccgccttcctgtccgggcccggctccaccacgctgccgatggtgatcttctcgcgggtgcggctgggcctgaatccggaaatgaacgcgttggccaccttgttcatcgtgttggtgtcggtgggcgtggtggcggccaacatctatatgagcgtgatgacgcgcaagcgggaaaaggagatgcggctggctttcgccaatggctgagacgggtggtgcgcagtgctgtcggcaggttcacacaaggagaaatgacgatgaagagggtactgatcagtgcattgatcgcggcgctgcccggcgtggcgttggcggatgcgaaagcggacgaaatcgccaggctcaaggcgcagatgcagaaactgcaggcgcagatggcggaattgcaaaaggcggtggaagcggccacggccgagaaaccggcccctgcggcatcggccgccgcggatgacgccaatgccgatctgaaggagagggtggccggcatggaattgaaagtcgaccggctcaacaccgccgccaacgaggggccgatcgccggtctcagcgtcaccggttacctggaccccacctatatctataaccgcggcaacaacagcgcgggcttccagttcctcaaccaccagaacacctacgcctacagcaacagcaccttcggcgacgtgtacctggacatcaagaagacgttcggcgtcggccccaccgcgcccagcgccgaaatcagcatcatgcccaaccgcggcagcggcaacaccctgttggatggcggcagcggcaacaacatcatcaacaccgcggtgatcaatgttccgttgtcggacacctggtcggtcaatgccggcttgatgaacagcttcggcggttacgaggtgcagcagtccaaccagatggtgacgctgacccatggcctgctgtacgacttcagcgaccccggcagctatgtcggcgccggcttcgcctggagccacgacgtgtgggcgtggaagttcctgctggccaacgagcaataccgcacccacgccaacctggccaatgccggcaacagcagcgtcaccggcgcgccgcaggtcaagagcaacaacacgccgacgatgaccgcgcgcgtcgactacacctggagcagcgcgctggatctgggaggatcgttcaacgctggccgccagacgctgctgacaggctcgaattgccaaggcagctacggttaccagtgcacggcgaacagcccctactcgaattacttcttcaccgaagccgacgccagctacacgctgggcgacgtccagtacaacgccgaattggactacggccagcagcagaacgccgcctggaacggcggcaacgcgcagtggtacggcgtgtcgctgctgggccaccgcaagtggatgacggacacggtgggcaagatgggggcgacgctgcgctacgactatctgaatgacagcaagaacggcggcggcggcggcggcatcgcgctgggcagcagcgggtatgacggaaccaacgcgttcggcgtgtcgccagcctgcgtggccagcggcgcggccaactgcaagggggccaaccgccaggcgctcaccgccgatctgctgttcttccccaccgaccagctgacgctcaaactggaataccggcacgactgggccagcgaaagcgtgtttctgcgcaacgacggcagcttccgcaagaacaacgatctcttgggcgcgcaagcggtctatagcttctgatgcctggcgcggcgtgcggcggcggggcgacccgccgctttttatttggagccgccatcgctctgcggcaaaatgcggccatcatttactgttcgagcttgcgcatgtttcgtaattttctgccgcattggccattgccgcgctaccgggccgactccgcccgttcccaccacggcgcggccggctatcaaaacctgtatccgttcaagcagccgcgctttgccgatctgttgcgctggaactggcaacgctggcggatgccggcggtggcgcaccggctgcaggacatccgccggcaaacgcccgacgccgcggcgctggcggccaacgccagccagccctcgtacacctggatcggccacgccagcggcttcatccaattggccgggctgaacctgctgctggacccggtgtggtcggagcgggcgtcgccgttgaggtgggccggccccagacgtctgctgccgccggcgctggcgctggagtcgctgcccagaatagatctggtgatggtcacccataaccattacgaccatctggacttcaccaccatccgccgcctggcgcggcaggccggcggcgcgccgcagttcgtcgtgccgctgggcgtggcgcccaccttgctgcgcgccggggtgcccgccgcgcacatccatcagctggactggtgggagagtttcaaattgggcggggtggaggtggtgctgacgcctgcgcagcattggagcaaacgcatgatcttcggcgaccgcaaccgcgcgctgtggggcggtttcgccgtgcgcggcgacggcctgcagctttggtacccgggcgataccggttatcatcccgagctcttcgcgctgattgccgagcgcatcggctcgctggacctggcattgctgcctataggcgcttatcagccgcgctggtttctgcaagcgcagcatatcgacccggccgaagcggtggagatcttccgcatcatgcggccgcgccgcgcgctggccgtgcactggggcactttcgtgctgaccgacgaggcgctgcaccagccgccgctggatttggccgcggaacgggacaagcatggcatcgatgccgccgatttctcggttcccgcgatgggcgagactttctggctgccccccgattgatcagctgcggggcgcgctggatcaagcaatgggcattttcctgggcacgggcggcatcaagcattgccggtgcaggcttaggcgcatacaatcaaacacaagtttattttcagaagcgaagacgcgttttcgttttcgcggcatttcgtggggctaccaatgacaattcatcaactgatcaacgagcgggtacaggcggcgctggcggcagcgggcgcgcctgacgcgcctgccgtgattcagccggcgtccaagccggaattcggcgactatcaggccaacggcgtgatgggcgccgccaaggcgctgaaaaccaacccgcgcgcgctggccgaaaaggtcgtcgccgcgctggatcttgccggcatcgccgacaaggtggaaatcgccggaccgggtttcatcaatattcatctagcccctgaatatctggcccgacgaagcgaagccgccctgaaagacgacaagctgggtctcgcgccggtgaagccgcagcgcgtgatggtggagtactcgtcgcctaacctggccaaggaaatgcacgtcggccacctgcgctcgtcgatcatcggcgacgcgctggcgcgcgtgatggaatacgtcggccatgacgtggtccgcgccaaccacgtcggcgactggggcacccagttcggcatgctggtggcctatctggtggaaaccagccacgccggcgacgccgacctgcagctgtccgatctggaaaccttctaccgcaacgccaaggtccgtttcgacgagagcgaggacttcgccaataccgcgcgcgactacgtggtgaagctgcaaggcggcgaccaggaggtgctgaagctgtggcgccagttcgtcgacgtgtcgctgaagcactgcgaagaagtgtaccaaacgctgaacgtcggcctgaagcgcgagcatgtgcgcggcgaatcgtcgtacaacgacgacctgccggtgatcgtgcaggaactgcgcgcggccggcctcttgaccgagagcgatggcgcgcaggtggtgttcctggaggagttccgcacccaggaagacaagccgatgggcgtgatcgtgcagaagaaggacggcggcttcatctacactaccaccgacatcggcgcggtgcgctaccgccatcgcgagctgaagctggaccgcgtgatctacgtggtggacgcgcgccagagccagcacttcgcccagatgttcaccatctgccgcaaggccggtttcgcgccggaagcgatgaagctggagcacgtcggcttcggcgtgatgatgggcgatgacggcaagccgttcaagacccgctccggcggtaccgtcaagctgatcgagctgctgcaggaggcgcaggaacgcgcctacgcgctagtggcggaaaagaatccggacctgtccgaagagcagaaacgcgaaatcgccaacgcggtgggcatcggcgcggtgaagtacgccgacctgtcgaagaaccgcatgagcgactacatcttcaactgggacaccatgctggccttcgagggcaataccgcgccgtatctgcagtacgcgtacacccgcgtgcagagcgtgttccgcaaggccgaggactatgacgcgggcgcgaagatcgtcatcgccgagccagccgagaaacagcttgccgccgcgctggcgcagttcgaagacacgctgaacgcggtggtggaaggttgctacccgcactatctgtcgcaatacctgtaccagatcgccacgctgttctcgcgcttctacgaggcctgcccgatcctgaaaagcgaaggcgaagtgcgcgccagccgcctgcagttggccgcgctgaccgcccgcacgctgaagaccggcctggacctgctgggcatcaaggtgctggaggcgatgtaagcggcatccgcatgcgcttaagcaagccaaaccccgccagaccggcggggtttttctttggcggtccggacacgccggctcagcccagctgcgccagccgctcgcggatgcgggccggctccggcagcgcttcgtcccaatccacccggcgatagctgccacgccagagcaagtccgcgccgaagcaatcgcaacccaatgcgcggatcgattccggcaacgcggcctgcgcttcttccaatagcagccgctcttcctccaggctcaaggcgggcagttcgttccaggcgcgtccatccacccagcccatgctgcccaggccggcgatcagccgcgtccgcatgggccgcaggcggaaaaacatgaaatccagcgccagccattcctcggcttccggctggtagcgcagcagccgcgcgcacaaggcgtcggacgcatcgaagcgctctgcgtcgcccagcatggtcagccgagcggcagattgggcggcgtcatcgtccggagacagcaaggacaggctgatgcgcgggtcggccagcaggttcttgctgtgttcggccagcgcgctgaccacgaataccggccgctggcgctcgtcgcagaaaaactggatggcgctggcataggggtagccgggatattgccgcgactgggtggcaagcgtggcgtggcggcattgatgcagcaggcggatggcgaggtcgggtttcatggcgttggcgggcagggaaagatgccgacattctaggccggcgcgcggccaaagcaaaacgccccgcgtcggcggggcgcgtcgggcagggcgggctcagaagccggcggtcttgccgatgaagctgttgagattggcgacgttgaggctgccccagccggtggcgtaatcccagccagcggcagccttgaaagcgccgttgccgccgccgctcacatcatggtacagcgcgggattggccttgaagtatttgtagatggcggtggcaggcgagcttagtttgttgccgtttgccgattggatgcggttccagaagccggtgaacagcggcgccgccaggctggtgccgcccacttggtaggcggcgccggccaccagcaccagctcgccgctgttggggtcggcatcgaaggcgatgtcgggcacgccgcggcgggttttgctgacgctcagcacgccggcggcggtttgccatgccggtgcggcttcggtatagctgggtccgccgccgccgccgctccaggcttgctcgctgccgtaggcggcgctgccgttggtggcgagcgtggtgccgccgaccgcgaccacatagggcgataccgcggggtagctctgataggcagtgccgccgccgcattcgtaggagccggcatcgccgctcgataccgagaaggtctggccatgggcgactgcagcctgcagcatctggtcgacactggcggtcatgccggaagcttgcgcgcccagttcgcattcgccgagcgagacattcaccactttggcgctgttggcgctcaccgccttgttgatcgccgctgcgatgtcggcattgctcatcgacggcgctgcgtaaaattgcagctgtttcaaggctccgccgctggcggccaggatggtttggctgtccagattccactccacgatgccggaggtgtcgccgctgggcgcgccggcgttgacgatggcgacgctgggcgcggcgaagccggcgctcctggcgtagctgttcaggtcggccaccgtctggttcagattgccttcggcgatgatgccggccacgccgcttttggctgccggcaggctggcggcgttatagatcgatgcgaaatcggcgggcttgtgggccatcacgccggcgctggatttggcgacggcctgcgcgcggaaggccgcgtggaactggtggacattctgcaggccgtgcaccgccagcacgatgccggccaggctggccggcacctgagcagtcgccacgttggcgacagcctggcggccgttgacgttgtagcggtgcagcctggtttggaaagcgctgtagacggtggcggcgctgccgtcggcgtggatcagcagattattgggatcgacgctgatgttgcgaaagccgttttgctgcaaatggctgaccacctgctgcacctgggcggcggtgggggcgtattgggccatgaactgggcgtcgctgatcggctgcccctggccggccaggatgccggcggtcagcgcgtcgagtccggcttggttgcgtagcgccagactcaccgcgatttggaccagctcgccgctggcgatctctccattatctgtcgcgctggggatcaactgccgtaccgggtgggcttgggtgccggtggcggcccagccgccggcggcatgggctgccaggctgatcgcgctgcccagcagcatggcaagggtttgatttttcaacgacatcccagctctcctgatagaaacccgtcggacagttccaagattagtacgggtttttactagatagcgagggctctccgctttttaaagcaattactctcaaattacccgttttatctgtaattgaaatgtgaaaatgacggcgtggtgccatgcgcaggctgttttgagacggattggcgtggggcagggcgcaaagaaaaaccccgggcaagcccggggcggatgactgcaagcggcacgcttcgatcagaagccggaatggctgccgatgaaggtgttcagcgcggagacgttcaggctgccccaaccggtggcgtagtcccagcccttggcggccttgtagccgccgttgttgccggaagtcacgtcgtgatacagaccggtgttggccttgaagtactgatagaaggcggtgttcggcgataccaggttgttgccgttggcggactggatgcgggcccagaagccggtgaacaacggagcggccaggctggtgccgccgatttgctggctgctgccttgcacgatgaccagcgcgccgctgttcgggtcggcgtcaaacgatacgtccggcacgccgcgcttggtcttcgaggtggtcagtacgccagctttggtttgccaagccggggcggcttccacaacgctggggccgccgccgccgccgttccataccgattccgacgagtacttggtgccgctggtggacagcgtggtgccgcctaccgcgatcacgtacggcgaagtggccgggtagctttggcctgcgctgctgccgcattcggcggagccggagtcgccggtggagaccgagaaggtctggccctgggctacggcggtctggaagatctggtcgtcggaggcgacggtgccgtcgctctgcgcgtcgctttcgcattcgcccagcgatacgttgatcaccttggcggaaccatcgctgactgcggagttgtaggcagcggtgatatcagcgttggtcatcgaggtggcgacgtagaagttcatttgctgcagcgcgccgccggcggcggccaggatgtcctggctgtccaggttccactcgccgatgccatcggtgtcggacgacgcgtcgccggcgttgatcacgttggtctgcacatagctgtagccggcggaatcttcaaactgctgcaggtcttgcagggtttgggtcaggtcgccttcggagatgatgccgacggtggtgttggtagcggccggcaggctgctggcgttgtagatcagcgggaagtcggtcgggttgtggccggtgacgctgttggttttggccgcagccagggtcttcacgccggccttctgcagggtggtgtggaactgatgcacgttctgcaggccgtgaaccgacaggacgatattgcccagcgattgcggaacctgagcggccgtcgagttggcgaagccgctgcggccgttcacgctgacgtggcgcaggctggcgttgaaggcggtcttggcggtggcggcgctgccgtcggcgctgaccagcatgcggttggcggcaaccttgatgttgcggaagccgctcttttgcaggtgggccactaccttgtccacttgcgcctgggtcggcgcgtattgagccatgaattcggcatggctgagggttttgtggctggtgccggccagcaggctgctggtcagagcgtccagttgagccttgttgcggaccttaagggtgacggcgacatgcacggattggccggcggcgacttcggtggtggccttggcggcggtaagggtggccagaaccggatgcgcttgagtggcggtattgacccaagcttcagctgcgttggcgccggcgccgaacatgccggcgatgatcaatgcaatagcgtgctgttttacaaacatgcaaatttctcctctttgcagttaagtgcagggggcgacggtatgtctttccctgatatcggcggggtttgtattgcggattgtgtccgcgcccttcgccttgaaacatcctctccgtttcgggaggcatgtcgtaatttcatacgactatttcgcaatagattaaacgcagagaaaatgccaaatggatttaacacaaattcataattacagcgtgtatttaatgaaatagacaagaattatccattttgaaagattgagcattcagttaaatgacgaaatagagcatttattcaaatttgaataaaatcagcggttcagtatttctcatgtgttgaatgagtaaagctgataaatggtgtcgagtgcggtgtggattatttgtgaaaaacacaacagaaagctgaaaggaaatgcataaatgcaacaattcagtggggaatcgagtgcggtaaaagatgtgtatttatgtgtttatgtgacagagtgtgacgaatgtatcggcggatttagcgaatgcgcccgcaatgattgaaatatggattgtgacggtttgtctctataaaaaaagcaaatattcacttccttttacgttgcaatcatgaaagtaaatggttattgacgttagtcattacaaactttcacactcaaaacgcatctcctcagtatgaaaaagacatagagccatgtgcccacgaggcgaatggacgacacatctacaaaagggatttggagaaatcatgaattacaagagaaaaactctggtggtggcgctttcgctgatcggcaacgtcggctatgtccaattggcgcacgccgacgacggcacgctggaccgtgtggagatcaccggctccaacatcaagcgctcgatcaagaaggaaaccgctgtgccgatgaccgtcgtcaagactgacgacttggtcaagcaaggcctgacgacggtagagcaagtggtgaacagcctggccgcgaaccagtcttcgcaaggcgccaacgccgctgtcggcgcttccaccggcggcgccgcttttgccagcctgcgcggcctgggccagcagtacaccctggtactcctggatggccgccgcatcgtcaaccagccgctggatggcactgcggttgacctgaacgccatcccgctgtccgtcatcgaccgcgttgaagtggtgcgcgacggcgcttccgccatttatggcaccgacgccattggcggcgtgatcaacttcatcaccaagaagtcgattaccggcctgaccatcggcggcgagttcgtcggcccgcagcatcccggcggcaaggaaaagagcggctccgtcacctatggctacggcgacctggccaaagacggcttcaatatctacggttcgttcgactaccacaagaccgatccggtttttgccagccagcgtgatttcgcctccctggtgaccagcagcaccaagctgagcgcgaactccttcccgaccacctacctggacccgaccactgggaaaatggtcagcgccggctacccgcagtgctcgccgccgtattccattccgaaaggcggcgtctgcaaggaggtcttctcgctgttccccggcattcagcccgaggttgagcagaagtccggcatagtcaagggcactacgatgctgggcgaccatgagttgtcgctgcagtacatggttacccaaaccaagaatatcagcagcgtcgctccggccccactgtccggcgatgtgacgtctccgactgcgcctggcctgccgagcgccgacggcccgttcccgttgtacggccgcacggtgccgatgggcaatcgagttgaccagagcatcgccacgacccaacgtctgcaagtgaatttggaaggcttgttggcggggtgggattatcgcgccggtttggggcactcgatgagcatcgtgacccacgatctggtgagcggctacccgggaacttcgcagctgcagagcgcgctgaataacggcttcgatccttccaatccgaatcccgccgcatggcagagcatcggcgtttccggccagatcgaaaacgccaagtcgactctggacaccgctgacttcaaggtcagcaaagaggtatttcagctgccggccggcatggctgcggtggccttgggcatcgaggcgcgccatgaggaaatggcgcacaactataatctgggtctggctggcaatgcgctcagcacaggcctgaacaacacgacttcggctagcggcaagcgttcgtcgcaagcgctttacggcgagatggacatcccggtgatcaagaatctggatgccaacctggccgtgcgttacgaccactacagcgatttcggcgattcggttaacccgaaaatcgcgctgaaataccagccgaccccgcaagtgctgttccgcacttccgcgagcaccggcttccgcgcgccgtcgctgtataacatcaaccagccgagccagcttcaactgaccgaagacaactataccgatccggtatattgccctggcggcattaagcagccgggtgcgggcagccagtcttgcgtgagcacccagcagaatctgcaagtagggggcaacaagcacctgaatgcggagaagtcgtcgtcgctgtcgtttggcgtggtgttggagccggtgaagaacttcaccgccagcgccgacttctggtggacgatgattcagcacaccatcggcacgctgccggagcagaccatctttggcaacccggctaaatacgccaatctgtttgttcgcgacgccaacaacaatctgctgtatgtggtcgacaactaccagaacctcggcaataccagcgccgcaggtgtagacctggggctgtcctactcgttcccgcacaatgccttcggcaacttcaccgtttcgctggatggcacgtataccagcaagtactcgtatcaacacgaggaaaacggtgtgtatgtgagcagcctgggcgcctatgtggattccgctccgaccttccgctggcagcacaatctgtctctgaactggagcaagggctcgtggggcgcgttgctgagccaggaatacaagtctggttacaccgaccagaacacgattattccgggcgcggcgcacaacgtgaactcctacgccacctggaacctgtccggctcctacgtttggaacaagcagctgtcgctgacggccggcgtgcgcaacctgtttgataagactccgccgtggagcaaccagcaggctaccactccgcagggctacgatccgcgctttaccgacgcgatcggccgcgcttacttcctgaaggcgtcttacaagctctgatagcgaagagctgtttggaacccatgcggcgggagcctggctcccaccgcatgggggaagttgcggatagacccagcaaggctggattgtccttgtgtgtcgctgccgcgcgcatcatttcgatatgaatccgaatgcgctgccgcggacagcatagctgtcaggtagaccccaatatggtaagtgcctccctcaaacgtaatcccaatctgagaaaccggcgcagcgccggcctgatcggcgtgatcgcgttccatgctctgctgatctacgcgctggtgacgggcttggcgcagggcgtggtcaaggtgatccagcagaaagtggaagtgtcggtgatcagcgaaccgccgccgccgccaccgccgccgccgccgaagatcgagaaagtggtgcagccgacggcggcgccgaagccgcaagcgtatgtgccgccggtcgtgaatccgccgccggtcgtgcaatcggcgaacgcgatccagtcggtgacatcggatccgaagccgcaacccgcgccgacgccggcgccggtggtggaagcgccgaaagggccgatttcggcgaaagccaactgcagccacctggaagcgccggagtacccgagcaaagcgcaggaagacgaaatccagggcgtggtgcgggtggtgttcggcgtaggcgcggacggcaaattcagcgggatcagcaatatcggtttcgacggcagcatcccgccgcgctaccgcagcagcttcaagtcggcgatcagcgccgcattgcaaggctacacctgccaggccaattcccagctgacgcaggaattcggcttcaaactcgactctggctcctaagaccagggcatctcaagacacaaaggagtaaataccatggctaaattcacacaagctctgctgggcaaggcactggctgcggccgcggcgctgagcgcgctgccggcgatggcggcggagacggtgaccacggacaacccgtacggcatcgacgcgctgtggtcgcaaggcgacttcgtggcgcgcggcacgctgatcattctgctgatcatgtcggcctccacctggtacgtgggcatcgtcaagctgctggagcaacgccgcctgatcaagcagggtcacgaattgctgggccaccacggcgtggacctgcaaaaagccgccagcgaactggcggacgaaggcatgtacagcgcggtagcgcaagccggcatcgaagcggcgagcgaacacaagggcgaactgtccaaccgcgtggacctgaacacctgggtgtcgatggcgatttctgacgcggtggactccgccagccatcacatgcaaaacggcctgtcggtgatcgccaccgtgggttcgaccgcgccgttcgtcggcctgttcggcacggtatggggcatttaccacgcgctggtgaagatcggcacctcggggcaggcctccatcgacaaggtggccggtccggtgggcgaagcgctgatcatgaccgcgatcggtctggcggtggcggtgccggcggtgctgggttacaactggctggtgcgccgcaacaagctggtgctggacaacgtacgcgtggtgtccggccgactgcacgccagcctgctgaacaacccgacccggtaattggccatggcccgttataaacgctttggccacggcaagggagacgaggatcaggtgctgtcggcgatcaacaccacgccattggtggacgtgatgttggtgctgctgatcatcttcctgatcaccgtgccggtggtgacgcaaacggtgaagatgacgctgccgaaagagcagaacatcccgacgcagacgaagccggaaaacatcgtgctgggtgtggacacgcacaacacgatttactggaacacgctgccgatgaagagccaggaagacctgctggcgcgactggtgaaggaagcgaagaagacgccgcagccggaagtgcacatccgtggcgacgcggcggcgaagtacgcgccgataggccgcatcgtgctggcggtgcagcaggctgggatcgtgaagatcgcgttcatcaccgagcctccggcgcggaactaggagaaaagacatggcgatgaatgtagggtcgtcgggagaagacgatctgatgatggaaatcaacaccacgccgttgatcgacgtgatgttggtgatgctgatcatgctgatcatcacgataccgatccagacgcacgcggtgaagctggacatgccggtgaacacgccgtcgaagccgctggagaagccggtggtggtgcagatcgacatagcgccggacaattcggtgctgtggaatggcgagaagctggcggggcgggagcagctggaggcgaagctgacggcggcggggaaggcgagtccgcagccggagctgcacatcaagccgaacaaggacgcgagttatgagccggtggcgatggtgctggcggagtcgcagcgtctgggtttgacgaagctgggcatcgtcggatcggaacagttcgtcaanggttcgaccgcgccgttcgtcggcctgttcggcacggtatggggcatttaccacgcgctggtgaagatcggcacctcggggcaggcctccatcgacaaggtggccggtccggtgggcgaagcgctgatcatgaccgcgatcggtctggcggtggcggtgccggcggtgctgggttacaactggctggtgcgccgcaacaagctggtgctggacaacgtacgcgtggtgtccggccgactgcacgccagcctgctgaacaacccgacccggtaattggccatggcccgttataaacgctttggccacggcaagggagacgaggatcaggtgctgtcggcgatcaacaccacgccattggtggacgtgatgttggtgctgctgatcatcttcctgatcaccgtgccggtggtgacgcaaacggtgaagatgacgctgccgaaagagcagaacatcccgacgcagacgaagccggaaaacatcgtgctgggtgtggacacgcacaacacgatttactggaacacgctgccgatgaagagccaggaagacctgctggcgcgactggtgaaggaagcgaagaagacgccgcagccggaagtgcacatccgtggcgacgcggcggcgaagtacgcgccgataggccgcatcgtgctggcggtgcagcaggcggggatcgtgaagatcgcgttcatcaccgagcctccggcgcggaactaggagaaaagacatggcgatgaatgtagggtcgtcgggagaagacgatctgatgatggaaatcaacaccacgccgttgatcgacgtgatgttggtgatgctgatcatgctgatcatcacgataccgatccagacgcacgcggtgaagctggacatgccggtgaacacgccgtcgaagccgctggagaagccggtggtggtgcagatcgacatttcgccggacaattcggtgctgtggaatggcgagaagctggcggggcgggagcagctggaggcgaagctgacggcggcggggaaggcgagtccgcagccggagctgcacatcaagccgaacaaggacgcgagttatgagccggtggcgatggtgctggcggagtcgcagcgtttgggtttgacgaagctgggcatcgtcggatcggaacagttcgtcaaatgacattcaaatagccattgtcttatggcatgatgagaaacaggcggctgcggttgggccgcctgtttcgtgcgcggagggtgttatcctccgtctgtcgccaatccatgcaaaaccggctgcgggcctcgccgcccgcaagcgggaacacaatacacatgaacacacgtcattgcctgatagccctccttcttttgccgcttgccgcctgcaacaagagcgatggcgccgaaaagccggccgccggcaagagcgcgtccgcgccggtcgcccgcagcttgtccagcgccgatgtgatcaaggcgcagatccagccgctggcggccaccattcccttcaccggctcgctgaccgccctggccagcagcgcggtggcggccgaagtggacgccaatgtgcgggaagtgaaagtgagggaaggcgaggcggtgcgccgcggtcagttgctggcggtgctggacgccgaggcgctcgggcagtcggtggaggagcagaacgcccagctggacaataccaagtcgcgcttgaagctggccaaggttaagttggacaagcagcgcgagctgctgggcaagggcttcatttcccaggtggcctatgacgaactggaaagcgattaccgggtgaaggagggcgaattgcgcgcccaggcctcgcaagtggcccgcgccaagcgcctgctgcaggacacccaggtgaaggcgccgattgacggcgtggtgttcgagcgcaagatcaatccgggcgaagtggccagccgcaatatgaagctgttttccatcgccaacctgtcggtgctggaaatcgccgccaccgtgccttcgcgcctggtgtcgcaggtgcgcgtcggcatggacgccagtttcagcgtggatggccgcagcgagctgcagcatggcgaagtggtgcgcatcaatccggtggccatccccggcacccgcagcttcacgctgttcatccgggtgcagaaccctgccggccaattgaaggtgggccagttcgccaagggcggcgtggtgctgcgcgcagtgaaggaccaggtggtggtgcccttgtcctcggtgcgcgacatcgacagccagccgtggctgatggtggcggagaagggcaaactggtgaaaaagccggtgacggtgcaactgcgcgccgaaaacgagcgccaggcggcggtggcgggcatcgcgccaggcgccagcgtgatcgtcggcgagttgctgggcagcaagatcggcgacgccgtcggcctgccgggcggccagggttgaggggcgcgacatgtggctgacccgagttagcgtacgcaacccgtacttcgccgccgtcctgatgatgacgctgatggtgttgggcttgttctcctggcagaagctggcggtggaggaaatgcccgacgtgcgcatgccgatggcggtggtgtacaccccgtattccggcgcttcgcccgaagtggtggagagcgaaatcagcaagccgctggaagaagcgctgaacaccgtcaacggcatcaaggaaatccgctcctattcatccgaaggcagctccttcgtggtggccgagttcgaactgtcggtcgaccccatcgtcgcggtgcagaacgtgcgcgacaaagtggcgtcggtgcaggggcagttccgccgcgagatcggcacgccttcggtttcccaggtcgaccccaacgacaagccgatgctgtcgctgtcgctgacctccagccagacccggccgcgcgaattgagcagctgggcggaaaacgtgctgaaaaagcggctgcagatggtggagggcgtcggcgacgtcagcctgatcggcgcggtgaagcgcgagatccgcatcgatatcgacccggtgcggctggaaggctccggcctgtcgctggccgatgtggccgacgcgatcaaggcggccaaccaggacttcccggccggcaacgtctccaccgcccagaaagagtgggcgatccgggtgtccggcaagctcaagtcggccgaggatttcgccgcgctggcggtcggctaccgcaacggcacgccgatccggctggacgacatcgccgatgtggcggataccgaagccgaacaggacagcgtgtcgctgatcaacggccagcccggcctaggcatcgacatcaaggcggcgcgcggcgccaacgaggtggcggtggcggccggggtgaagaagttgctggaagaattcaagccgcggatgccggccggcaccgtgctgcgctacacctatgattcggccgaggatgtgaagaaagcgctgcacagcgtggagtcgatgctgctggaaggcgccggcctcaccatcctgatcgtgttcctgtttctgggcagctggcgcagcacggtgatcaccggcctgacgctgccggtggcgctggtgggcaccttgttcgccatgcagctgatgggcttcacgctcaacatcctgaccctgctggcgctgtcgctgtccatcggcctgctgatagacgacgccatcgtggtgcgcgagaacatcgtccgccacgccgcgctcggcaagagccattaccaggcggcgctggacggcaccaatgaaatcggcctggcggtgctggccaccacgctgaccgtggtggcggtgttcctgccggtaggcttcatgagcggcatcatcggccgcttcttccaccagttcggcctcaccgtggcggtggcggtgctgatttcgatgttcgtcagcttctcgctcgacccgatgctgtcgtcgatctggcacgacccgcaccaccacggcgacaagcaccgcggcccgctgggacggatgctggattggttcgaatcctcgctggacggcctgtccgagcgctacgccaaggtgatccattgggtgctgggccatcgcaagacggtgctggcgctggcgctgggcatcacggcgggcagcttcatgctggtgccgatgataggcggcgaattcattcccgagcgcgacagcggcaagctgaacgtggtgtaccagaccgcgcccggctcctcgctggaatacaccaccgccaagggacgggagctggcccaggcgctgtcgggcatccaggagatccgcacggtgtcgctggatgtcggcgccggcaatttcggcgccggcaagaacgacggcacgctgactctggacatcggcgacaagcatcaacgccaacgcagcttgaacgaagtgatcgccgatgcccgcaagcgggtgcagccggtggccggcgtgctgatcaaggcggtggccaacgacgaacagcagggcaagccggtattcatcggcctgcgcggcggcgatctgcgcgagttggacgcggtgtcgcgcgagatcatgcgcaagatcgccaagatcaagggcgtgcgagacattgaatccaacctcaccgagggcgacccgtcgctgagcctgaccctgaagcgcgacgccgcgctcagcctgggcgtggacctcaaccgggtgggcaatctgttgtcgatgctgttggccggcaacgtggtgaccacctgggaagcgcccaatggcgacaactacgacgtgcgcttgcgcatccccaaggacgcgcggcgccaggagttgctggaccagctcaaggtggcgggcaaccgcgacgagaacggcgcctcgcaaatggtgccgctgtcctcgctgatcgaaacccggcaggggatcagcccgcgccagatcaagcgcaccaatatgatgcgcgagatcagcatcatggccaatgtggaagggcgcgacgtcagctcggcgatgtccgacgtcaacaagctgctggagggcatgcagctgccgccggacgtgcaactggtgaggcgcggccaacagaaggatatggatgaaaccatcagcaacgcgctgcgcgcgctggggctgggcgtcatcttcatctatctgatcctggcggcgcagttccgcagcttcaccatgccggtaaccatcatggtgtcgctgccgctggctttcggcggcgtgttcttcgccttgttcctgtgggggtcgacgctgaacatgttctcgatcatcggcatcatcatgctgatgggcctagtggccaagaacggcattctgctggtggacttcatcaaccgctgccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcctggcggcgcagttccgcagcttcaccatgccggtaaccatcatggtgtcgctgccgctggctttcggcggcgtgttcttcgccttgttcctgtgggggtcgacgctgaacatgttctcgatcatcggcatcatcatgctgatgggcctagtggccaagaacggcattctgctggtggacttcatcaaccgctgccggcaggagggcatggagcgcaacgcggcgatcgccgaagccgggcgggtgaggctgcgcccgatcatgatgaccagcctggcgatgattttcggcatgctgccgctggcgctgggcactggcgatggctcggagaccaaccggccgatggcgcacgccatcatcggcggcctggccacttccacgctgctgaccttgctggtggtgccggtggtatacacctatctggacagcttgcgcggccgcattcgccggctgttgggcgggaaacgcaaggacgcgctggtattgaaggccgaaaacggtaaataggacaggcgccggcttgggccggcgtctgtgacaatgacagatttatttgcgcggctgggcgacgcaatcgttgccgtcgaagcttaccgactggacgacatggtcatgcgggtccaccacgaaattggtggtgcaactgtagtacaccgaaccgccgccgctgatgccccaggggtggtaaaagccgctgctctggatcggcatgtcctggctgtacgcgttgcggtaggtgtacagcagcttgccgttgggcatggtcatctggctggtgggcgtgccccaggcggccagtagttcgttggcgtcgcggccttgccagaccagcaccttctgcgcgtagccctgctgggtggcgcagccggcgctcagcaggcaggctgcgagcagcaggacggtgagaggggtcttcatttccgtttcctcgcattctttgggtggggaatggcgcggatcgcggcgattgcagctgcgaccgtcccaaggcggccattcatgggttcttcataattctgcttttattttacgatgatgtcagcgccgcccgctgtcaatcgttaaggtttgggcagaaaccgccatctgttaacaagattgtgcaacaggcggccggcgcttgatcgggcgcgacgcggcggcagaccgcggcgccccatccgccggctccgatgaaaacaacaaaggagaaacgactatgtgcctgagaaagcccatcgcggcggcactgatggtctgggggagcatgttgccgatgcacgcatcggcggagaaagtgctacatggcgtattcaacgcgcaggaaaccggcttcgacccggccaaggtgtcggacgtgtattccgccgcggtgatcgaacatatctatgaccccttgctgaccttcgactacctgtcccgtccggtgagggtgatccccaatgtcgtcaccgcgatgccgacggtcagcgccgacggcctgacttacacctttcatctgaaaaaaggtatttatttcgcgccggacccggctttcaagggcaagaagcgcgaactgaccgccgccgactacgcctatacgatcaaacggctgtccgaccctacggtggcctcgccgctgagcgacaccttcaccggcaagctggtggggctggacgcgctggtgaagaaagccggcaagggcaagctggattacgacgcgccgctagccggcatccagacgccggaccgttacacgctgcagctgaagttcaagcagccgttcccttcgctgccctacgtgctggccggcagctgggtggaagcccaggcgcgcgaggtcatcgaggcctacggcgacaacaccaacgcccatccggtcggcaccggcccctacatgctgaaggactggaagcccggcaacagcatgacgctggtgcgcaaccccaatttccgcagcgagacattccattaccaggccggcgccgacgcccgggaccagcggatcgccgcgcagatgaacggcaagcgctatccgcagatcgaccggatcgagatttcggtgatccaggaggagcagccgacctggctggcgttcaagagcggcgagctcgacgtgctgagcggcaaccccagcattccgcagccgctgattcgccaggtgctgcggctggacccgcataatcccgcgcgcgcggaactgaaggcggaataccgcgagcgcggcatccagctcaaccgcagcctggaagagggcatcacgttctacgccttcaatatgaaggatcctgcggtcggtggtttcggcaaggacaagatcgccctgcgccgggccatcgcgatggccttcgacaacagcgagacgataagcaacatccgccgcaaccaggcggtgccggtgcagtacatcgtgccgcccaacgtcgcgggccataaccccgacttccgcgccgcctatccgttcaacccggcgctggccaacgcgctgctggaccaagtcggttacaagataggcgccggcggctaccgcaaccagcccgacggcaagccgttcacggtggatttcgtcaccgggccgacggccatcgacaagcagtggaacgaatactggcaaaaagccttcgaccgcatcaaggtgcgcgtcaacttccgcgtggtgcaatggaacgagcaggccaaggcgctgcaggagtgcaagttcggcatagccggcgcggcctggggggcagattatccggacggcgacgatttcatgcagctgctgtacggcccgaataccggcggcagcaattactcctgctaccgttccgcccgcttcgacagcctgtatgaacagtcgcgggtgctgcccgacggcccggcgcgcaaccgcctgtacgatcagatgaacaagatcgtggccggcgacacgccctgggtctacggcgacatccgctatgtcaacggcgtcgcccagccctgggtgagaggcttcaaggtgcatcccaacttcaacgccatctggcgcttcctggacgtgcagaaataagcggcccgcgaggagaacatcatgtccgcattcatcattcgccggctgctgcaaatgatcccgaccctgctcggcgtcatgctgctggttttcacgctgttcagcgttgtcggcggcgatccgacgctggtgctggccggcaaacacctgacgccggaagtgctggcgcagatccgcagccagctcggcctcgacaagagcctgcccgagcaattctggctgttcgtccatcaggtgctgacgctgaatttcggcacttcctggtccacccagcagccggtggccgacatcatcggcagccgcgtcggcccgtcgctgacgctggccggggcaatgctggtggtcgacctgctgatcgccatcccgctggccgcgctggtcgcctattttcgcggcggcctgaccgaccacctgatcaccatcatctgcacggtggcgatgtcgatcagcgcgctgatctacatcatcgccggccagtatttcctggcgttcaagctgggctggttcccggtgcgcggctggggcgattcgttctggaccaatctgttcctgtacgtgccgctgcccttgctgatgggcctgatggtgtcgctggggccggacatccgcttttaccgcagcttcttcgttgaggagctgggccaggactacgtgcgcaccgcgcgcgccaagggcttgtccgagcgccgcatcatgctcaagcacgtgctgcgcaacgcgctgatcccggtggtgaccagcgtgatgatgtcgcttccttatttgctgatcggggctttggtgctggagaacttcttcggcatccccggcatgggcaacgaggtgatccaggcggtcaacaagagcgattttccggtgatcaaggccatcaccatctacatcgccatcgccaccatggcgttcaatctgctgggcgatctggtctacaagtggatcgatccgcgcgtgcaactgaaataagcgggggaaaacaatcatgacgacactgcagaatgccgcgggccatccgccggccatgccgtcccgcagcctgtgggcgctgggttggcagcgtctgaagcgcaacaaggtgggcttcatctctttatggatagtgctggcctatttgctggtcgccatcggcggctggtgcaatttgataggcagcagctggaccgacgaggtcggcgtgccatacgcgccgcccagttggataaaaccgtcggctgacgacgtgttgccgcctgagcgggcggcggcgaaagcggcggccgcgcccatcgtggcgatgagtccggcggaagacccgataagcgaagagctggccgcggcgcagaagcatgtcggcgactatgccggcaaggcgcagacgcgacgggacacgctgccgttcggcggcgacttgcaaggccgggatgtgatccagaaaaccctgaaaggcacgtccacctccattttcgtcggcgtcttcggcgcggtgtgctcgctgatgataggttgcgcgctgggcgcggcgtccggttacttcggcggcaagaccgacgacttcctcaactggttctacagcgtgttcacctcggtgcccgacatgctgctgctgctgtccttcgccgccgtgtcgggccgcggcatcggcactatcatttcggtgatggcgctgaccagctggaccggcacctatcggctggtgcgcgccgaatacctgaagttgaagggacgcgaatacgtgcaggcggccaatgcgataggcgccggcgacatgcgcaagatgttcatccatatcctgcccaatatctcccacctgctgctggtgcagttttccttgctgacggtggcgctgatcaaatacgaggccattctgtccttcctcggcttcggcgtcgacgtgcgccaggtcagctggggatcgatgctggaagaagcgccgaccgaactgatccagggctattggtggcagatgctggcggtgaccgtggccatgtcggtgctggtgacagcgttcagcctgctggtggatgcgctgcgcgacgcgctggatccgcgcgcggtggccaagtaggaggcggcaagtggagaaccatcaaatgaatcagcaaaacaccctgctgtccgtgcgcaatctgaaggtgggtttccgccaggaagacggcggccgcttcgaggcgctcaagggcgtcagcttcgacattccggcccaccgcacggtggcgctggtcggcgaatcgggctccggcaagtcggtgacgtcgatggccatcatgcagctgctgccgccgcaatccagcgagatcgatccggcgtccgaactgctgttccagggccgcaacctgctgcggctgtcgcgcggcgagctgcgcagcttgcgcagctcgccgcgcgacagccgcagcaggttgcggccctggaacagcagttcggacgccggatcgatctcgctggattgcggcggcagcagctgcatgatggccatcgacgtcaccgacttgccggagcccgattcgccgaccagcgccaccgtgcggtgggccggaatgtcgaagctgacgcccttgagcgcctcgaagcggccgccgtcttcctggcggaaacccaccttcagattgcgcacggacagcanaccggattggcaagagcattttctctgctgaactatctacatataattcttgctttagcgcaaaaattagcaccgccaccaaggttaacctgccattgcgtatccgaaagaggcaaggagctatcaggagagttttgaccttcagaccaccatgcggtcataacgtatccaccagagtatattaattttccattagggcaagttgcggcacttactgctccatgaccgcatgcattattgccatcaatgactactcctggattatttttagtagaggttgcccagcgaccggattggcaagaaagtatcaagccattggcatcacgcgcaatcaacccgggggtgttgcacccctgcgtgtccccctcgctaacctgcccagctagcaaatactcaccagtctgaatgcgcccccctgcattcacactaccgcccaccgtcgcgtttccgttaacccccagacttccgttgatattgccattctggcctacggacaaattgccattggcaatcaagttcctcttggcggtcacgtccagcgccgcggtcacactgccgctattcacgttcatgttgccgaagttgctggtgatgtcgccgttcatcaccagcgcccccgcaccattgatatccttggcattgacaatgcttttcgcccccatatccagattgcccagcatctttttgctgccatccaaccgcaggaaaacattcaggtcagagcggttgtagccgccacgcaccgccacgatgcccgccacgttagtcatggggttggcaatcggtatcgagttactattggcggcggttctgaaagtcagcttgctgaagtcgggaggcatggcggcgccgccgtccgggccaatctgctgcaccgcggaagccacggcgacatagtcgacgtcgtcgctcgccgatggataaggcaggcgcagcggcttgtcgacataggtcaaggcgttgatattgcaggtgccaggactactagcgacgcattgcctattaccttgcgtcgggtcgtcgccgctgatcacgatttgatatgacgcgccagccagcggcggcttggtgccaagcgagggcaagcccaccacgctggcgatttcagctggggtcgggctcaacgggtttgccaccccattcagcgggggaatcacggtttgattgagcacggccagcaccagctggtcatggtgctgcaccacgtagctctgtacgcccttgcccaggtccgccagcgcgccgcccaacagttggccgcggctggcccgccattcgccgacctggcgcacgcccagatacgccagccccatgcctatcagcgccacggcaatggccaggcctatcagcatttcccccgcttgcttcctgcgcattacgcccccctgccctgaatgtttttgcgtctttgtatgtctatctctccctccaggcgcgcgtattcgcccttgttgatgaattgggagaggtctttgcgatcgcgcagatcaagcgaagtgacctgcggaatgccgttgtccaggcgctggtgaaacaccatgcgcagggagtcggcgatgaattcgtcggcctgcgcctcgccgccggctctggccagcgacgccaggcggcgcagcgccgacgggatgtctcgggaatggatggtagacagcaccaagtggccatccaccgcgatgcgcaacagctccgccgcgctatgcgcgtcgcgcacctcgcctatcattagcatggagcggtcccgcgccgggaaggagcgcagagcggtggtgatggcctccgcgtagcggcggtcgaaattgaattcctgcccggatggcgagtcggccacgtctatctgcgtgcagtaaccgtcgccatgccagccctcgataacaatttccaccgggtcttcaaccgtctgggcgaaaccgccgaacttctccagccggctcaccaccatggcattcatggtggtggtcttgccggagccggtcagcccggaaaacagcaccaggccgccgcttttcttcagctcgtccgactgcatcatggtggtgtgaaagtccagcaggcgcagatcattcaggcgcggcgccttgttcatcaccagccggcaggcgtagcggtactgctgcatgcgctgcacccgccagcgcagcccgccgatggtgatggtgaagccggtgcgccggcccacttcctgctgttcggtgagcaccacttcggtcagcttcatcaggaaattcttgtactcctcgccgggcttgatctgcccggggaaaagcacgctggatttccagtcgcgcacgtgcagctggacatcggtaatgatctgttgcgccatggactttacacgccctcatgcctgcgcgcgttcacgcagggctgtcgattacaaggaaaatgcataggtaagggtattggacgtcgaggcattgcaggcggtagccaatgcagccgcattcaaagcaacaccagccttcagatctttcaccgtggtggtgccgacctggatctggacaaacagcgactggatattaggaaccagacgcaagcaggcctcggacgaataaccggtcgataccaactgcaccgcgtccttggaggcgtagtaatcgatagcggaccaggtcacggtgccgccgaaacggttgaggatggtggtgccagacacacggtccgccgccatcagtttcaggctgatagccaactggttagtcaagccggccgccggcacgccggaaccgaacacccgctgcgcttgcgaaacctcctgctgcaagtcggaagtctcggagttcgacttgatgttggtcatgattgacggcaccacgagaaagccgatcgacaggatgaaggcgatgatgcccaccgccaccgacagctgaatcaggtcaatacccgcctggcgtttgagcgagccgcttctgccagaagccgaacgccatttcgaagcattcatgggatctccaatttgcttgttagttgttaaatggaatatatactatatcaaactttgaaaacgattggcaaaggctaaatcacatgctgccgccaccggtcatctgctgaatctggttgccggcctccaatgccgtcatcatcatcccggcgatagtaagcaagatgaaaagacccaccactacgatcaaaacgttacgcatcacggcggagcgggcgctgatcacctcggagatttcctcgatggtggtcaggcctatcttgcggatgccgttttcgaagttgctgcgttcggaatattccgaaatccggtcgaaaatctcctcggagaacaggccggtatccatcgccttcagaatgctgcggttgctggtcagcgccaggcggatgcgcgccaggtgccagcgcatccacggcgtggcgccctgctccagcagcagcacggcgtcgtacaccgcggtattggcttgcgacaacgccgccagcgaaaccagaaactcgctggctttcaggtcgcggtataccgaatacggcagatggcgatccagccgattgcgcagcggactggcccagcgcggcagcgaccagaagtaagccacggccagcaagcccggcaagccgtaaatcagataccagtaattgcggatggcctgcgacaggtagtacagcaccttgcccaccagcggaaagtggtccgccggcatgatctgctccatgatgggcatcatgcccaacgccacgcccagctggacgccggtcatcagcagcagcaggaataccggcagcgcgatcgccatcttgatcgcctcggcgttgccctcgcggattttcaccaccttggccagaaagcgcagcgcttccggcaggtcgccgcgctcgccggagccgatcaccatcaggtcgtcggccgggatggtgccctcccaggcgccgcgcaggttcatcgacgccgcgcggtcgcgccaataggcgaacaatggcgccatcacattgccgcgctcgcgcgccagcatgtatttgtgggaaaacagctcgtatgggttggcgccatcctcgatggagtcggccaggtcgccgtagaacttggtgcgcagcttcatgaacttgcgcttggctttggccaggccggcgtatttctgctcatgcgccggggcgatgccgaaaaaccgcttgatcaggttcagcatcacaagctccccgcgctacggtaatccacccgcccggcctgaatcgcctggaacagcagcgaactgatgcgctgatccggccgcaagcccttgtccaccaggtcggccagcatgctgacgccgaaatcgcgctggcacagcttgccgtcccacacctcgctaagccatacctcgccggcgtagccgctgccgcagcagggctcgcgcagattgcgggttttgacattgccgaaatcggcgctgcggaagttgctgaccacttcggtcagctcgcgcgccgccaggtcggcatccaccgacaacgcgcaaatcggacacagccccggcaggcgcaccgtattgacgcccatggagacacgccccttggcccagcctggctgctcgcccagaagcagcatcaacgccgactcagccgtgctgttgcggcccggaaacaccgccagcgccgggccgtgatgggcgcgcagcttttgcgcgtccgggttcagccacaccgacggcaggcccgacgcggcggccgaaccggcggcggcgccagccactccctggctccaggcctccgccatcagcgccgcggccatcgcctcggccatctcgcccgccacgaagacaatcgcgccggggcgcgacaactctttcaccaggcggttgaccaccatcttgtcgtcaagtccgaacgccgcaagcgccgccgccttgccgcgctccccgccgactttgccggccgcgcaccagatgccggcatcggccgggtccggctcggcgcccaaagcgcccagccattgcgccgcctcgccggcatccatcatggctaccgcttccatgccttgcgccgtctccagcagcaacagccgccggccgtccgcagccggcgcggcgtagacgcgggcggcgtcagccaccgccatcgcatagccgacatctcccgccgcgacgatctccggccacaggaagcggcgcagcgcccaacggtaggaataagaggtcagcaaaaccactcgccagcgttttccggcctggtccaattcgccgcagatttccgccacgcggcctctggcctcgcggctggagccatccgccacgatcaatgccggcacgccgtaagcggcgcccttcaggtagaagtagccgtgccggccaagcccgtcgccgttgcgggtggccgccggcaattcgctgcgcgcggtcagcgcgatggccgccagatcggcaaacgcctgcggctgcgcctccaccggccaatacgcagccgcctgctcggcgtagcggtcgtcattgaccaggcccaaggcgtccaggctgtcgaacacctggccggcctcatgccccaacaggccgcgctccgccgcgatccgcgcccaggatggcaccggcagcgcctcgctcacttcatgttcctgagccagcgccaccggttgccgcaccgcatccaccagcggttcgaggtatcccatgtcgaactcttcgctgctatgcacgccctcgccgcgcgcttcctgcgccacgcgatgcagcaaggccagcctctcctcgctgagactggcggcgcgcctagccgggggcggactggacggcaccggctccagcggcgccagcagctcttccatccgcagcggcgcgaaaggcgctcgctcctcggcggcctcggcaggcgctatcgccggcgcttctggctggccggcggcggaaaccgcttcccgcacgctgtccaggcttatgccgaaaccgctgtcaggaaagtgctgcaatggcgcgtccagcaacaaatcgggctccaccgccagcggcaacacttcctccgcttcgtcatcctccgcgccatgctccgccggcgcggcgtccatggccctgccggccgggcctttgccatacccgaatctgcccagcagactcttgaaggcgtcatcaccattggccatccctgctccttcaatcaattggccagactcaacggccggtattttttcagcttgcggaacgccgactccacgtcccgcgggtccagcaatcccagcgacatcttgtagagagcatgctccatcgcggtcttgcccagcatcctggggtcgtacagcttgccgttgctcttggcgcgccaatccttctccgcctcccagaagcgcccctcgcgtatcagcggcagcatgtcttccgtcacctcgcacacttcggccaccacggtctggcccttggtgcccaggttgcggcaggccgggcagcccggccccatcacccgcaccatgcccacgtctatgcccagcgaggcgatcaccatcaggtactcatcatccagcacttccgcggccagcaggctgcactccgggcacagcaccggcaccagcttctggtagaccagcgcggtgaggaaatccggcgccgccagcgcctgcaccggaatgccgatttcgtcgtcggtcagccgcgggatgatgccgaagccgctggaggcgtggacggtggacagcacctggtggccggtctgcgtcatcgccttggcgaaggagccggtttcggcgtcgcggatttcgccgcccatcaccttgtccgggtccccgcgcagcagcaccttggccgccgcgccgaacggcgtttcgccaccctctttcttgccgtcttccgccttgcgctgaatcggaatctgcgtgacatgcggctggatgtattccaccgggtcttcgatcgagaagaatttcttgccggactcgcgctcgtaggtcatcagcgtgcgcagggtggtggtcttgcccgaaccggtttcgccggcgatgatggtcaggcccggcgagcggtacaccgcatcttccagagcctccacctggtcgtcggaatatcccagctgcgacagggtgaggatgtccttctccaccgcctcgttcagcagcacccgcaggatcacgtccaccccgcggttttccttcacgctctggaagcgcagctggtagctgcgcccttggacagccatgttgatcgagcagctttgatgcttgttttcgtcgaagtggttgtggctgcggctgctggagtcggcgcgcgagttgtaggcggtggagatcgcatccatcatcgcgttgaaatcgcgcagcagccggtctttgggatcgctgtcgcgcagcttgccgtgaacgcggtagcgcaccagcacctggttgccgtcgcggaattcgaagtggatgtcggtggcccgcagatcgatcgccttttcgatcaccaggtcgaagttgcgatagccgccggtcttggcgtcgccgtcgcggtggctggattccacgctgtgctgctgcagctgcgagtgcaccagcaggatctcttccatcgaccccacgtaaatgcccaggcagctccacttggtgcgcgagcgcacgccggcgtcgaagcgctgcagcagatcgccgccgcgcagctgcagataagccacgtcctccaacagcaggatgtactgcttggatttggcggaccccagcaataaggcgctgttctcatagccgggcaacaccaggtcgccctcctgccgccagccaaggtgacggatggactccgatttcagcccgccgatccggcgcaccgccaaaccctgggatgccggctgccggctgcggccatcctgccgggactccggcgaagcggccgatttggcgtccccgcgccccattacctcagaaaaccaactgcacatggcgagacctgcctctccacttcccgttcaacgctgttcaggcccgctggccgcgccggcatccatcagcagacgtttacgcttgcccgcatgggcgacgtccacgtagtcgtcgccgaccgccaccactttccacgactgcaccacatccccctcgcgcaccatcttgccgtagcggccatccaccaccagataggccttgcgcaccttgccattgccctggatgaacaccacgtcgaacacctgggaggagccgttcttgcccggaagcgccgtgccgctgttcaccaccggcggaggcggcgcctgcgacggcaagggcggcaaaccgccaggtatcgccgcgggagccggcgccagcgcgttcttggcaaaggaatcaatggtttccgcgcaggccagcgcaggcagcagcaacagcaagacaagcaatttattgaacataaaaagtacccttcgccgtgaattccggctttttatcgttgagcgtcacctcgacggcatcgagcgtcatattgccggcccgctccatcaaacccggcaccgaatccaggaacgccagatggccctgcatgctccagctgcccttggccagcgcgggcagcttgcccacccgccccttcagctcttggggcaacggcaccaaggggtcaaccttgcccaataccacggccatcagcttgtcctcgttcttgcctgttttccccatatcatccagcgcctgcatccgcacgccggccgtcatgtagaactttgatacgtccaccggagcggactgcagcgcggcctgcgcctccggcaggggcacgacttccgtcgcgctgcccatgtccaggaactgcaccgtcttgcgttgctccagcaaggtctggaagttgccgccgtcctggcgcttccagttgatcgtgcatcccttttccttgcaggaaatattgcccacccgccagccgcccacctcgaacggcaactgctgcaccaccgccagcaccgtcctggcgtatgccgcgccatgattgagcggcgcctgcttcagcgcgctctgcatctggttgcggtaagtcgtcatcgggtccggctgctggctggccgccgcgtccagcgcggccagcctgtctttttcctgctgctgcatccaccaccagccgccaccagccgccacgcccagcgccacgaacaacaaggcgacgcccaacagccgcgtccccggcagcggctgcagccggtaggccgccttttcctcgtcggtcagcgaggtgacgatgtcttccaggttgacgtgccgagtgacctgcagcatgtcgtcgtcgatatcgcccaggatggtgacgccggtgccgacctcctggatgaactggcgcgcggcgtccagcgccgcctcgcgggcgatgacccggtcctgcatcggcttgccgtcgtggatcgccaccagcaccagccgggacgggtcctccggatcctgatgcaggaacaggatgttcggatcgtccgacacctcccgcagcaagccggccagcgcgaaaagctcgctcttgcgccccttggccggcagattcgccaggccagccacccggacgcccagcgcgttctgcaacaccaggcattgcttggcgccgcggcgcgaagccagttcgcgaacctcttcggactccttgctcagccccagcagcggttcccactggacctcgaccgccaggttgccgaaaagcactctggccatgtcacactccctcggtgagctgcggcgtgatcacgatgatggtttcgtcgtcgccctgttccgccgttttggtgccgccctcgtaattgaacgcgcccttgcgggtagtgttgttcttggcgcggcggaaaccgctcagaatcagcgtctgccccgacttcagcgacgcgcgctgcatggtctgcaccgccgaggtgatcggcgtctggatgctgctgctattgctgctgtcgccgcccgacgaggcttccttgatttcgatcagctcggacaggtcgatctgcacttgcagcatcacgctgcggttgtccagcaaggtgggcagcaggttcatcacgaaaccggtggtcaccacgcccggcgtcaggccgacgctgggcgccgagccattggagcccggcgtcgaggtgatgctggccagatagccctggttgttggtgacggccaccggcgccggctggttgttcagcgtcaccacattggtgttcaccaccgtgctgacccgcccctgctggctcaatgcctgcagcaaaatcttggaaccgttgaactgcccggaattcatggtgacgccgaactggccggcgccttccatcggcttgccgaacgccgagctgaatgtgctgccccaaccgctgttggccgattggtacacaagcttccaatcgatgccggccgcgctcttctcgctgaggctgaccgtgaacacctgcaccgacaagctcacctggcggcccagcaccgcgttttcgccatcgatgtactgccgcacccgctccaccacgtcggcggagtcggtgacggtgatggagctggtcatttccgacggcatcgccttacccataggcgacagcatgctattgacggtgtcgctcagcttgtcccagtagcgcagttcggaggtcatgctgaccgaagagtccgaaccgaagttgatcgacgaaccgccgccgccgccgctgccgctgccgctactgctgccgccgctgccgccggacgtggtttgcgagctcttgccgaccttggccgaataggtggatacgccgggcatggtcttgatctggaaggtgcgggtcaccaggcgagagaattccaccacgccgttgcggtagctccagttggtgccggttttgttcgccaccgcgtccagcaggccgcgcaaggtgccggagtagttcagctgcgcccgcggctcggcgtcctgggtctgcgcgccgggatacgtggcagcgcccatgcctcccatgcctcccatcacacccgagccacccattcccattccgcccggcagcggcggcatgccggccggcggcgtgggcatgcccgcttgcgggctgccgccattggcgttgttcttgctgggcgtgatgccgaagatatcgcgcgccagccggatggtgacgccctgttccctgccgatctgctcggtcatcagcgacaacggcagctggcggccggagctgaaactggcgcgctgatcgaagcgtggcggcaggctgtctatgtcatccatcaccaccgagcgctgggcgaaccaggcgccggcatcgcgctccaccagcggcagcgaagggtaggtcagattggattcggcgctgcgcatcacctgctgcgtttccgtcacgcggtcgtcggtcttctgcaacatgccgggcgtgccgcaaccggccagcaacgtggttccgcaaaacgcggcgacaatcttcttcatgcctgtttccttagcgtgtcgcgtggatcacgcgaatgaccttgttggcctcgtaaaccttgatgcggatcggcgtatcgctgttctgcagcgatttggccacctgctccatcacctctaggaatgtcccgctgaacgtcgccgggtagtcgatggggaaatcgcgctccatctcccaggccagttcccagccattggccctggcgtaatcgcgcagggccgccgaaatgcgccccttgcccggcaccagcttcagcacgccgcgcccctggccgaactcgatggcgcgcccatccgcggcggggccggcagtctcgctggccccgccatccttggccgagtcgttgtccagatagagaaaacccgcctcggcatgcagcgcgcacatcagcaacgacgccgcgatcaatgtcttttgcttcatgacccgaaccttattgattcactttaataggtatgatatcaaactttttatgataccagtcaaataaaacgcaacccgctcagccacccggcaccggcatgcctctttgttgcagaatctgctggatggtcagattgagataacgccgcatgatcaccaggcaaccatacaggcgcacatcccgcaaaggcttgcgctcggccagctccatgtaatagtgcgccatcaccccgacaccctccatgaacaccgttttgcgccccacgctggccagcgccgcccacagctcggggtggtcatggcgaaacaggatgggccgcgcccagtcgcagcgcaccacgccgttcttctcgcgatggtgatgcagcagcctgaccatggcggtggagcggtaggcatgcttgtcgcaggccagcttgaccagcttggggctgacgcccagcttgcgcgcgaagcccaccagcagcggatcgttcgggttcgacggctcgcccacctgcttctccagcgccgccaggaatttctcgtcgaaatccgccgcctcgtgatccaggccgttgaggcgcatccattccgccacctggtagagctgtcgctccttcggatccaggccgcgggcgcggatcaccttgttgaaggtctggcggttggccgggcggccggaccatacccgccgcaccgcatgctccttgcggatgtgcttgagcagcaagggcgcgatcggcaaggcgatcagccagcccagcgcgtagtcgagcgcgatggcgcgcgccagcgtgggctgctcgcgcagccattccgcgccgtgggcgaacggcgcgcccagcaccggaatcttggccagaaacaggtagcggctgtaggtgctctgcatccacttcagccacaaatgcggcgcgaaatatatcgccaggccagccaaggccagcgccgcgatgatgacgaacaccttgtcgtcgccgccgcccccgccgcctccattgcgcgccgccatcagtccggactccggtaggcgggccgcgcgcggtacaggcggccgctgaacttggccttgacgtaacggaaggcctgctcgatcggcacgcctttgtattcaaacaggatcagcgcgccgaagatggccagcatcgtcagcaccgtaaaccagttgaacttcaggatcagcaccggaagtatgtaaaacgccttggaatccagccagggggtgaatcgcggcgactgggcggcaaacacccacaattgtccttccatgcctacctcaccagagagaatcttttgtcacgacataatgggggcggccttgttcatccttgcccttgtagcggatgctggcgtccgccggcgccgccgcgctcgtcccgctgccgccgccccaagaagcgccgaccgtgacgccggccaggaaaatcaggatgcccaccgccgccagcagcgcctcgtagggcaagcggtcgaaagccgccttcgccagctcggcgaactttgtcgaagtcttgtgttgtgtcatcatccgctcaaccgctcatcaggtatgtaatcacgtcttcctgccggacgcggccctgctcgatcaggtccagcgcgctttgccgcatcggctggccgtacaggttcaccttctcccgcatcagctggaatacccgttccgaattggcggcgatctcctgcgccaccgtgcccgcgctgcccagcttggtgaaatccaggcattcgcgcaccggcacgcgcttgccgtcggtggtcggcaccaagtgctggcacaccacgtatttcagcgtggtggccaggttgtagatcatcaccgcgcgcatcgcctgcgggaaaaacttggaccagtagtcgaacagctccgggatggtgttcgggtgcatggtggcgtacaccaggtggccggattgcgccgcccagatcgccgcctgcgcggtttccgcgtcccgcacctcgcccaccagcatgtgggtgggcgccatccgcaaatgcgcgcggatgccgtcggaaaagctctccaccgacgtgcccacctgcatctggtctatcaccgccgtcggcgccgccactttgccgtaaacgaattccaccgggtcttcgatggtgcgcagaatgcaggacgaatccggccgctccacgtggtcgcgcagcagcgacgacagcgtcgccgacttgcccgaaccagtggggccggtcaccagaatcaagccggaacgctgggtgcggctgacgtagatcaggtcttccggcgtgtcggcctctttcagcgtccacggctccggcttgatgcggcggaaggtggccgacgggccagaggtttcgctctgcatgtcgcgcgccacggccacccggtagcgctggccgtccacgccctcgtaaacgaagtccagcgagcgcgccttgcccatcaccatgtcgtaaccgttgacgttgtccttgtaggccgcggtcagcagctggcgcatttcgttctgctgcaggcgccgctgcatcaccagccggttgcggccgaacaccttggccaccgggtaggtgtcttgcttgaggaagacgtcgctggcgtcggagaagcggttgagcaggctttccagatcggcgcggctgactttcgagctattgtcgaaatcgtcgtcatgcccggacatcagcggcctccttcgaaaaattcgccggcgcccagatcgttgatcgccttccagcgcggcaggtccttgacgaacaccaccggctgcgacaccaccttgcgcgacaccctcacatcgatgccgccgtcggcgtccaccaccttctgctcctggcggaccaccttgggcgcgtccaccatctgcttgagccacagcatcttgtacagcagcatgccgttgaaggtttccttcagctgcgcgagcttgctctcatacgcgcccttggccgccgccacgccgctggcccagccctggcgcacgccgtcgtcccaggcggccttttcctccggcgtggccggtttcagcgccgcgtccggctcgcgcacttccggcaccggctgctgcatgtaatcccaccagctgggcgcggtggtgacaaagcgcgcatcctcgcgcacccggtacgaagcttccacagacaccatgctggtggggctctccagccgcacggtattcttggatgacgacagcaccggcggcagcagcgaatcgggcaacaacagccgggagaagtcgaatacctgcgacaacgtcgcgtcctgcgactgcagcatcgcgttcagccgctcgcactcccgcgcctggcccagctgcgcgccgtaggacaggccggcgttgtagaccgcgcgcaccttgagcgccgcttcttgcgacagatagcttttcggctgccagttcagagcgctttgcaacgcgccgccatcctcctgcggaatggagtcggccgcccaggctccgcccgccagaccgatggacaacacccaccaacacaagcgcctcatgcccgcctcactctacccgctggtgcagtcccagcgtttcgcgcaccttgcgctcgcccgcgccgtcgtcgacataggggcccaccgcgatctggaacttgcggcccgccggccggacctgggcggcgaagccctggttcttgtagccatccgccactcgcgccgccagcttgcggtcggcgaagatcccgccgtccatagaatacttctggatcagcggcttggaagccgaagcctggaaggcggttttcggctcgcgggtatcgttgatggagcgcgtgtagtccagcacgatggtgcgcgacttctcatccaccgccagcacgaaggggaactggtcgccgatggagcgcagcaccgcgatcaccggctgcgacgcgctcttgatgcggacgatgctgtccacgtcggccgagccgcgctcctcgaagcgccagcctatgctttgcgcgatgtcctgcacgatgccgtgcggcacgccgacgtattcggtggaatacaggcggttcaggtcattgctgggcgtggaggccaggctggccttcaggtcctgcatggccttgtcgccgctgttgaccaccgtcatgcgcgccagcagctgctggctgcgcgcggcatcctcggcagccttggccagcatcgccagctccgggctggcggccgcttgccgcgcggcgggcgcggcgcagccggccagggcgcaagcaaggccggcgatcaggaatggcgtagcagctctcatcaaatcgcgctccatatatttactttggtagtaatcatatcaaacattttaaaagcatgccggttttattgaagcgtggccggcggcagtacctgcgccgccagatccgcatcgcccaacacctgttccagctcgccgcggcgatagtcgaaatccgacttccagcgcccgatctgctccggcacccgctccagcttgcggaacagcatggtgcgcggatgcgcgcccgcccactcgcacaggctcagcaacgattcgtgcggcatgtcgatcagccgcgccagcagcagatgcgaaggcagaaacccgtgcagccgataccaaaccccgtcctgaaaaccgaccgccggcgcgtcccgccctatccggccgccatgctcgcgcgcccagtcttccggcaccgacacatcgccctcctcgtcggcgaaccagtaggccagcatgtcctgccatactccgttgtccatcaatgcccccccgcaatctcggctacgatttcttttatgatgtccgcctcgcgcttggcgccgccccaggcgtcgatgcgcttgtccagctcgctgaccgcgtcgccgccggggaagcgccgggccagccggctcagcgcctcgcgatagccgacgaagcgcgccacctggctgcggatttccacattggccggcgtggtggcgtaggcccacaactccaccccgcccggcttgaagtacagcacccgctccaccaccgcgcccttgatgcggctgtacagcagcatcggcgcgcccagcggcgtcaggccctggatgcggttggccagcgcctcgtcggcgtactcgctcaagtccatggtttttttcaggtcatcgcgcacttccttggagtcggcgcgcagcacccagatattggtggccaggttcatgatggacttgggaaagtcggtatgttcctgcgaggccagcgcgatatgcaccttgtacttacgtcccacccgcaccagcgtttcgatcagccccagcaccatcggcgagctgatgttgtgcaactcgtcgtagacgatgcgcttcacctcgttgcggttcttgcgcaattcgcggcgatggtactccatgtattgccccgggcaatccatggtcggcaccacctcgtcatccatatagaaaccgcgcgccaggaaggcgctggtcgccagatacatcacctcgccctgcttctgcgacgccgcgccctgaccgccggtgacgtcggccaagtccaccgcgacgatcttggcgttggagaagtccagcgcggtttcgtaggccagcagcgggaagcggctgctgatcgaacccagcatgcggttgcagaaatccagcatcgacgagccgccgggaatcaccgcgtcggtgtagttgtccttgatgctgggcgtggcctgcatcacctggctgaggtcgggaatgatgggcaccgcgtaacgctgcgccaccgtggcggcgcggatctcgttgcgatcgaacaacatgtccaccacgctccaccacgacgcctcctcctccggatgcagattgttgcgctgcagcgcctcatccacctccggattgcgccgcggctggtatttcttgggtttttcgatcgagaaatagcgataggcggcggtcaccagcgtatccaccagctcggcgatttccggcaccggctgctgctgccccaccggcgtcagcagcaaggtgacgaagtccacgagaaacgccttttcgtccggcaccgccgcgcggcaacccagcatggtgtcgaacggattcatcgcgttgcgcttgtcgatcgacagccggtaatgctgcgccaggtattgcttgtccaccggcaacgaggccttgacggtgtcgatcagccccttggacgaatagccgacgtccaggatggccatgcgcgggatgtcgtccttgcccggctgcagaatggagcccaggttgagcgcctgcagcaacaccgatttgccggaacccatggtggcgaacatcacatccacccaggcctgctgcagctgcgagcccacctggtagacgaacagcttgccgtcctcggtcagcatcatcatattgccgtagccccatggcgaggccggccgctcgatcggcaggatggccgccagcatctgcgacggcatgatcaattcgggcgccagattgcggaaacccggcaaggtgcccatcgccacctcgcaagggttgccgaattcctgtatcacctggccgccgccccagccgttcagcgccgccgccagctcggtgaagcggtcggtcgcctcctgcttgctgccgccccaggtcaccaccgaaatcttcacgccgacaaaggtggtggcgccgatgcgctccagctccttcacctcgttgatggcgtcgacgatcttggagttctgcccgccgaaggtggaaaacttgaggaattgcgccaccgacttcttggcggaaaagcgcccggaagcgctgccggacaatagctggaacgccacccggaacggaatttcgccatggatgcgcgcggtgggcaggatgcgcagcaggttgttgaacacctcgggctgggaaatcggaaattcgaaatagccgctggaatagaagcggttgcccaccctggccacgccttcttccgggatgttttccagttggcggcggaaaatctgcaaaccgggcagcggcggaatgatgtcgtcgcgctggccggcgatggtcgatttcgcccgcgccggcaacacgccggtcttcttcaccgaatcgggggtgatcgggctgaggccctctccggagccgtcccacaagtcggcgtccagcacgatggcctgctccagcgtcaagggctgcgccttgaggctgaaaatgctgaccaacccttccacgtattccttgcacacccccaggtggcggttgcgcatcgctggcacgaagctttcgctttgcgccatctcgccgccggaccagttggcagccaccttgcgcatttccttgggcaggatggaaggcgaggtggtgaccacgatcagcgcgatctccgacgtcacggtgcgcgacagaatctcctcgcgctcgtccaggatgaagttgacgtccatgccgatccgggcggtggccgagcgtatgctgttggcctgcttcctgacctccttgcgcgaggtttccttgtcgcgctggaaaatgatgtccaccacgatgccggagcgccgcggcaggctggccagcatcgccgacagcttgcccagccgctcctggtaggcctcgccgtcgaacgattgcagcgcgccgtccagcttgtagatggtcatcaggctgccgccgcgcaaagagatgacattgcccgagccggtggtccacgcgcacttgtcccatagcgcggccccgcggatcttgggtatgcgcttcatgaagttgtcaaacgcgtcaaatattgtcgtcactgctcacctctccactcttccaggccgcggcatctcgcctcagccctcgctctgcgccgcatcatggcgccgcagcgcctccaccccgtccggccggtacgacaaggggaaaatcaatctcaggccgttgcgggtgagaagcttgaccgtttcctcgtaggagtcttcccggttcttcatcagcaccttgaaaaaggtggccagattgtccaccgtgccgcgcccgcccatatagctttccaccagcttgaccgactgctccaggtgcagctccaggttatgccccaggccgccccgcgccagccgcggcatcgcgcggcaaatccggttgatcgcctcttgcgaacggcccttctccacgccccagaacgcgccggcccgcagcgccgcgcccacatgctgggtggcgcggcagtaatggcacagcaccaaccagttatccggactctcattgccgtagtcatcgtccagcggttcgccttccaggaattcgcggctgcggtagccgcaaaactggcaggcgtgccggcggtattcaaacagcgaagcaaggaaaccggcggctgggcggccggaaacggcatacacgccgtcgtcgacgccgggatagttccgattgcggtatatttgcacgctcagcatatttaaatgttttataaaatatatactataacaaacattatacacataccgcgccatgtcatggcaataaaaaacccgccagaggcgggtcgcggcgcaagccagggtttacatcagggtgtggccgcccatgccgatccagtccggcgcgaaataggcgatcacgccgcccaggccggcgaacagcgccgtcttcatatggccgcggtcttcgcggcccggcttgccggacacgtagatgttccagccggagaagcccatgcacatcacgcccaccagctgcaggcccatgcccatcacttccttgaacgaggagatcagatccttggtctgcttggcggtatccatcaggctcttgccggagctgccggccgtggtggccaccgtgtccgccagcgaggtttccgtcgccagcaaggccagcaccgcaaccatcagaatcagatttccttttttgaacttcaacattgttccactccttaagcctcatcggctgcgttatcaggacagattggggaaggtgttgcgcaccagcgcccaagcgtcctccatgtagtaaagaaatatgccggacagaaacagtatgaaaatcttccagccgtctcccgcctgggcaaagcgggcatcgccgctcttgtacatcgcccagccggccctgcccatcgccgccaagcccagcagctggctgagcgcgtacaccacctggcgtatcgcgttgcccgccgccagcgcgtctcccgccagcaaggtttgatcaaacatcattgtcccccggcaaatgcatcatcaagaaacagcacgcccaccagttcgcttctgctcaggatcacctccgacttgttgaatctcgccgccgcggcggtcgccacctgcgccaccgcctccaccgttttcccgaccgcgtacttggccggctgatcgatcttgggcaccgtcgtcaccgccgcgccgttcaccaccgaggtctcgccgccgctggtcatcgccgtggcgtagttgcccaggaaggcgccggcggcgatcatgccgaagcggtcgatatagtgccccttgaccgcgctggccaccgcctgggaattggtttccttgtccaccagcaccgcgtccaccggcactacccggccatccgccagccgcatcttgttcagcttcaccaccagcgcgtcatagccctcggtgtaagaaccgaacagctgcgcgtcgcgcttgccgccgtcctccacgatccgcaccatcaccgtggtgccggtctggtaggacgaggtttcattcagcgtcaccgccgccacccgctcgccgatggacgccaccttccagccccgctgcggccgcgcgccatccgacgcgccgccatcgaagcggcccgccgcggccgccgcgccgccgtaccagttgaccagcttgcgctcctgctgcggcgcgtcgccgcggctccggttgttctggaacttctgcagccacgcgctctgcttctgcatgccggcggcgtccagcagcggctgcatggacggcatctgcggcaccggcggcatgccgccgccgcccgacggcgccgcgccgggatctcccctgtcgttcagcgcgcccacttcggccacgtaagcgccgccgctggcgatggccgccttctgcctgtcatcccgctggccattgagcagggcgtccgcggtgccgtacagagccggctggctgtggtcgtcggcctgggccagattgccggcgtcggccgcgccggtatcggccatcttgccgggcgtgctggccatcgcggtctgatcctgcccttccgtcttcggcgcgctgaccttcttgtaaaccagcatcgccgcgaagaaggcgatcgccacgccgccgaacaggatcagcttcatcttgctggggtctttgccggcgcccttgggttggttattgaaatcgaccatatcgggtttattgctcatagctgccccagcggatcacgatggcgcgggaggtgccgcccatgcccgccaccatcgaagatggccggtaatcgaattcataggccgagccgccatcgtcgtcgcgcgtgctggtgcggaaattgcggggcgacagcagcgtgacgccggggcgaaccttgacgaaaacccggttgtccgactgccgtttccagatcttcaccgcgtcgccgccgttatgcggcaccgtctgcatttcctcgccgacggtttccttcagcaccgccatcagcgcgccggacaacggcgattggtactcgtcgccgcgattgagcgcgtcgccgcccatccaggtcagccgcaggtctgcggcgaaatccacccgctcgccgcctctcggatacagcgagcgcaccttgatcaccaccggccggaacgaaccggcggcgaacaccgtcagcgaagtcgagcccgagcccgaggaatcgatcacgatcgcgtccttggcctcgccgccggagcctgccggagccggcggcaggcctgccgccgcgccggccagcgacgccgcctgggttgccacagacgcctgcgcgtcgccgggaatcgggtggatcgcgagaaaggccatgcccggcacgctgccggaaatcttcaagggttggccggcgacgtcggtcaggcggaccgtcaccggatagcccaccgccaccgtcagatccaccgtccgccccgggcgcaccgggatggtccgctgctcgccggccaccggcggcgaatccttcagcttttccactttttccacttggcggcggtacatgcggatctggcccggatcgaatggcaccgcctctttcatcaccgagccgaataccggatcggcctccatcgccctttgcagcggatcgcgcgcctgcggcctcgccgcttgcggcgcggccgccgccgacgcctgcatcgccagccggggatcgttggcgctgccggtataaaactgcccgcccgccgcgtcgcccggctgggccgccgcggcggcctgggaaagcaggcaggccgccatcaggcgcatgcccctcttaatctggcttctcacgcccttaccctctgtccttggccatgtaaagagcgagaatccggtagtccttcgtcccgcccaccgtcaccagccccaccaccaccctgaatttcatcgaattgtccgtacgcttggtgcggttcagataactgagcgtgccattggcttcgaactcccaggcctccaccccggcctgctggcctttgcccaccagaatgggcgagctggtgaacttcatattgctgatcagctcgttatccagcaccgacttgaaggttcccgccgcctccagctggctcttgaaagtcagccaggagtcttcggtgaaatacttgcgcgacgcatcggcgaaatgcggctccagttcggtccagttgtaattcagcacctggggcaaggcataggctatccactgcccggcctggccttcattcaacaccggggtgttgctggtcagcagctggtactggcggccatccggcgtcaccgcggtgaactgcggcaacggcgcttccttgcgcgccagcgccgccagcgccaccgcctccagcaggcaggccgcgcccagggccagaatgatcagggttttgcggcgcgaatcatggcgcagatttcccgactcacccatggtgtccctcagcgcccggtccacctcttgatcattcaaattcatcatcgacatcgaatttttccaaatatggttcgatacaatatctatcttatcaaacattttaaccatgacgccagcagaatgccaacaaaaattatggccgctcgccgcggccatcggttcaaccggcatgccggcgcgtcatgcagacggcgcgccggcccgtccaggcaaactcaaaccgccacctccagccccgacacgccaagtccggcgcggccgcccacccgcacctgcgtcgcgatgcgttccttcagcccttcgacatggctgatcacccctatcatcttgccgccggcgttgagcgcgtccagcgcgtccagcgccacctccagggtttcgccgtccagcgtgccgaagccctcgtccaggaacaacgagtctatcgaggtgcggtggctgaccaggtcggacaaggccagcgccagcgccaggctcaccaggaaactctcgccgccggacagggtgcgggtgtcgcgcgcggcgtcgccctgccaggcgtcgacgatctccagctccagctcgcctcccggccggcgccgcagcagatagcggccgtgcagcctggccaggtggcggttggccagacccatcaagtggtccagcgtcagcccctgggcgaacttgcggtatttgtcgcccttggccgagcctatcagcccgtccagccgctgccacagatcggcctcggccgcctgctcggctatccgctcgagcaaggcccgctgcccttgcctgcgctgcgcatcgtcgcgcagcagcgcctccagcgcgccctgtttttgcgtcaaggcctggcgctgaccgtccagcgcctgccaaccgctctccagcgcctccagatcggccccgcccaaatcctgctcccgcagcgacgccagccggccggccgccgcttgccgcaccgccgccgcctgcgccgactcgccctccaaccggctcctgcgcgcctgcaggcgttcgcgctcgccctccggcagcaaggccgccaaaaaggccgccgaatcggcgaacgggctggccgccagcgccgcctgccattcggcgtccacccgctgccgcagctctccctgcctggcaaggtccgcttccagctgcgccttgccgccctgcaagctggccagttcccgatcccactcctccgccctggcgccgcaacgcgccagcgcgtcggcatcggccaatgcggcttccgccccggccggctcggccgcgcccagcgcctgccagcgcgcgcgccagtcggcggcctgaacctccgcctgctcgcgcaccgcctgctgccggctcaggctttccgccagctgccgcaggctttgctgcgcatcctgccagctttgccaatcggcctgccgccgctccagccagccggcatccgcctcctctccgtcaaagccggcggcggcgatgtcggcatgcaggctggcggccaaccccgcgcattggctttgcagtgccttgtcgcgcgcctgcgcctgctccgcctcgcgccgggcgccttcccgcgcttgcagcagcaaggccagcgccgagtccgccgcttgcttttgcaaatcctgccggctgacggcggcgctcgcctgggcatggctggcctccgcggcttcagcggcttgcaaggcctggcgcagccgagcttcggcctgctccgcgtccgcgcggcggcggcgcggcgcctccggatccgcccaatccgcctcgcccgccccgcattcggccaggccggcgcgccacgcctgccgcgcctcctccatggcggcggcggactgcgcggcggactgccgcagccgctcccggccggcttgcaacgccgccagttcggccgccgcccgctggccgttttccgccaacgtctccagttccgcctccagcgcctgcaaggccgcttcgccggcggaaacgtccagcgcctggtaagccgccaccgccggatgctccagcgcgccgcacagcgggcaggcttcgcccggccgcaaagcggcccgatgcgtctccaaactgcggatgcgctgctcctgcgccagcagccggcgcttgtcgtccacccgctccttcagctggcgataatcgcggcgcagcgcctccaccagtccgccttgcctctccagccggcgcgcggcttcggccaactcggcttccagatcgcgcgcggcggcggcggcctgccgcagccccgccgcctggccatccagttgccgccatgccaaggcctcgcgctggctgcgctgccaatcgccgcgcaatcggtccagcgagttccccgccaacaaggcatcgcgctcgcggccgccggcttcctgcgcttgccgcgcctggcgcagcgcctgctccgcctcgtccagcgccgtccgttgccgctcgatctcgccgtctctttgcgccaggccgctcatcagcgcggcccatccccgctcctcttcctgccgctgccgcctcagttgcgccagctgggcgaactggctgcgccagccggccagccgctcgcccaagcgggcataacggccatgttgcccgctccagtcatccagctgccgcttgcgctcgctcaattcccggccgcggcgcgcctcttcggccgccagcgcggccgctgtcgcctgggcccgccaatgctcggccgcctgctccgctcggcacgcgtccaatcgttccccagcctcattcaatgcctgtctcgcgccgcccagcagctcatccgcccgcagtcgcgcctgataaaccggcgcgatcgccgcggccggttcgcccgcgcgcagcgcctccagctccggctcggccaggcggatggcttccatcgcggcttgcgccgcctgcgcggcggcggcctcctcatgttcagcttgccgcagttcgtgccgccactggcgctggcgccgcaaagtttccagctcggccagcaatgccgacgcctgcgccgccagtgcggcctgctcgtcccgcatccgcgccgcctgctcgtcgcccagcagctccacgccgtcggcgcgggccttgagctgggccagctcctgacggacatcgcgcgcgcgttcgaacacccgctgcgagatctggccgtagatgtcggtgccggtcagctcctccagcaactccgccctttcgttggcgctggcgttgagaaaggcggcgaatccgccttgcgccagcatcatcgacttggtgaaacgggcgaaatccagaccggtgatttcctccacccgcctgagcttttcatggctctgactggccaagatggcgccgtcgccgtcggccagctccaccttgggcgcctgcaaggccccgtcggccttgtcgcgcgcccggcgctggctccagaaggcccggtaggcgcggcccttcacctcgaactccacttccgccaggcaatcggcggtgtggcgggtcatgatttcgttggacgaggcggaaatggcgtccagccgcggcgtcttgtggtacagcgccaggcagatggcgtccagcaatgtggacttgccggcgccggtggggccggtgatggcgaacaggccgttgtccttgaacggcgcgcgggtgaagtcgagcttccactcgcctttcaatgaattgaggttcttcagccgcagggtcaggattttcatgcttcgccctcgcgcaggctctcgacgacgctgcggtagcgcgtctccaggccccgctgcagctcatcgtcgatatcctccagcgccagccgcctggcgaacacctcgaacggcgtcaactcatccagcgtttcgctggcctgagcctgcagcgccgccgccgcgtcgccgcgctcgcgacggatgcgcagcacctccagcggcaggccctccgtcatctgctggatgcgcgccggcagatcggccacgtagtcgtcgccccgcaccaccacttccagccacagcggcaggccggcgtctgcctggcgcgcggccgccgggatggcttcggccaagcgcgccaggtcgcccttcagcgacagcagcggctggaagatcggcaccggcagcggcgtgacgctgcgcaggccggcgtcgtccagctccaccagcagtacttccttttgctggccggcttcgtcgaagctcagcgcgatcggcgagccgcaatagcggatgtgctccagcccgcccaccttttgcggccggtggatatggcccagcgcgatgtagtcggccggcggaaacgcgctggtgggaaaggcttccagcgcgccgacgtagatttcgcgcaccgattcgctggcgctggcgccgacggtggtcaggtggccggtggccacgatgggcagcgccagccccagctcttcgcgccgggcgcaggccagccggtatagccgctggtaatgatcatgaatggcttgccgcagcgatagctgcttttcctcggcgctttgtccggcctggctttgcagcacatcgcgcgggcggatgaagggcaccgcgcagacaatggccccgggctggccgtcgcgccggcgcagcagccgcacctgatcggcgggatcgtcctccaccgcgggcaccaccgtggcggacagataggacagcaagggccggctttcacccagcgtcgccgccgagtcatggttgccgccaagcagcagcagctggacgccggcatcatgcaacgccaccaccagctggttgtaaagttcgcgcgcgtagctgggcggcgcgccggtgtcgaagatgtcgccggcgacgatcagcgcgtccgcctgatgccggccgatctgttcgaccagccaggcgatgaaggcctggtgctccgcctggcgggttttgccgatgaaatgctggcccaggtgccagtcggaagtgtggaggatgcgcatggcggggaaagaggaaaacggatggcaggcattgtagcagcccggccgtcaccgctgcggcttgagcgccatcaggaaataccgcgccaacagcggctcgtcccggccgccgcgcttggcgaaaaacacgcggcaggccatgccgaaaccggtgcccgccatcagcgtggcggacagtgcgaggttgtgacgatcaaaagctgttcatgacgccggtttcccttgatttcccaaccccagcggctctgaaatttctgtcgaaagagaaatgaattgagtgtgaggagccggcccatcggccggctccatcgcgtcaatgcgtgtccgccgtcctcgccgccggcggctcagccagcccggtgaccgacaccgcggcggtccgcaacaggcgctgtttcaagtttgccagatagtccgcccgcccttggcgcaggatgtagtcgcggtagttgtcgcgcttgaggtcttcccaggcttgctctctcgcgcggcgggaatgcgtttcggccgcggcggccagctcatcggtgatcggcagctgggccggcgtcagcatcgggtagccgtagcgttccatatagtcgcggcaggcggtttctatgatctcgatctcgcgcagcgacagctgctgccggaacttgtcggcatgcgcgacgatgggagggaagtggttcgacgaccacagcgccgacagctgagaaatctgcgccgcctcggccgagctgcggatgtccagcatctgcggcaaaaaggcgatgccgaagaagtcgcacacctggcgcaggatggtctgctggtcggccaggaagtcctcgtagcgtatcgtcagcaccttgtccgggtggttggccagcaggcggtccgccgcctggtaggcggccagccaggtgcgcacattcagcgcggtgtcgaaatcgtggatgatggcgcggttgaccgaagccacctgggcgcgcgggtcgcgcaccacgttgaggaagcgcatgttaggaaacagcgccaataattcgtcggcgtagcggacgctgtccagcgatttgtccatcaccacccgcgcctgattgtgctcccccgcccgcagcagcagctcccacaccacctggtgcacgctgcgcggcctgtcgcctatcgcttcgaagatctccaccgggtcgaaagccatgcccggccatttgaccatgctcgccgcctgcaggcccaccacatcgacgatcagctggaaataagccctgtcgtccgccaggtcaccgtacaaaggcagcagcggcatgaaatcgacgatgtgcagcgggtagggcgaatagaattcccggctgaagttaagccgcagccgcagcgcgtggctgccgcagcggcgcaacggaatcatcaggaccggcagaggccggccggcgtcagatgtgatattcatgatcgtgcctttcctcggccgccagcgggctgcaacagtgcagaaccatgcggaacagcatgtcgaccgactcatccagccgcagcgcgccggtatccagcgccagcgccggcctgggcggcgcttcgtacggagcggaaatgccggtgaagtggtggatctcgcctgccctggccttggcgtacaggcccttgcaatcccgctgctcgcacacagccagcgaggtgctgacgtaaacctcggcgaacttgccttcgccgatgatgccccgcgccgtttcgcggtcgcgcagcagcggcgaaatgcaggcgcataccacgatcagcccggcgtcgttcatcagccgcgccacttcagccacccggcggatgttttcctgccggtcctccgcgctgaaacccaggttgcggttgaggccgtggcgcaggttgtcgccatccagcaccaccgcggaatacccgccgcggaccagccgggcttccagttcgtaagcgatggtggacttgccggcgccgctcaggccggtaagccagatggtgagcgcgcggtggccgaacagctgctggcggtctaccagcctgatgcggccgccggttttgaaaatattggcgggaagcccggtttgcgtgggcgcggtgtccatcggcatgtccttcccgtgattgaatgcagccagccgggaaggacaagcgctttgcagcaatcacgcactagatagtttggtaatagtgcgaaataactggttagaactgaccaaaagaacagggacagtatttgtacggatcattaagagcatattgaagatgaaccgctcattcaaatggcttatcttgcacaccctcgccgcgccgcctctgccggctcaaaagcggacgccggcgctgagcatcgccaggctgcggtcggacaagacgttgtagctgccgcccccggtagccaggtacagcaactcgaaaacataacgtttgcggtattcgccctgcagccgccacaacgcgctgcgccgcccctccatgaactgaccgtcctgcgaatagcctttcgggtcgtagcccaacaccagcgacggcgtcaggtccagccccggcgcgacgccggcataacgctctgccagcttggcgcgcaggccccaggccaccgaggtgacgaagccatccagcgcgcagcttggcccgccgccgccgcagaacgggctggcggcgctgggcgccggaccgaaacccacccggccgtagcgcatcgtgtacgggtccggcaggccggccaggtatttgacgccagcctcgcccgacaggcgggcttcgccccccaaccatctgcccaacggctgctggacgcccagcgacaactggctgctgcggaaagtgtcgtagccgcgcgccagatagccggtgggcgtgtgcgccagatagcccagcggcccggcgccggtctgcacgccgtacaggaagtcggcgccgttccatgccactggctggttcggccggtagcttagctcgccgtagatgccggttccgcccggcagccgcgtcttgaaattgacgccgaacatatggatgttgtccggatagctgcggcggaattgcccggcgatgccgaccggcgcggcccgcccctgattggccgccgccggcagcaacacgccggggccggtgcgcagcatctggttgaagctcatcgggctggtctgattggaatagaacagccccagcaagcccacgccttcgaacagatagttgaggctggcgccgaattcgccgccatagggcttgtcgtccggcgcgcgctggatgtagtcgagcggattggcggccgactgctggtcgctggtggcgatattgctatgcgacaggatgctcagcaggctgccgttcaaggtcagcttgtcgcagccgggctgcgcgtagtcgctgccggaatagaatgtgccgcaggccggataggcgttgggttcgaatttgaactggtagtagccgtccagcgtcagacgcggggtggcctccagcttggcgtacagcgccggcgccggcacattggccatttccgggatggtgccggcgcggcccagcgcgttgaaatccagcgcgttcacctgctggatgccgccgaggaaggtggtgggcgtgatccacggaatcacctgttgccccaagcgcaccgacaacgtcgactgccccagagggtagcggccgtaaacataggcatcgtccagcaccacgccgctgaaacggcccaatgcggtgaagcggctatcgtccagcggcgcgccgggcgcatagccgttgggagaatggccgtgcggaaccgcgccatgactcaggccgtagtcgtaccaggccttggcgctgacaaacaggccggcgtcgcggtagcgcaggtcgccttgcagatagccctgccaggattcggacaccaggccgccgcggcggtagttgaggtcgccgtcgttcagggtatccatcatattggcgtggctgacataggccggatcgggattgcccgtccggtagacgctgccggccgacatcgcccccttcacttccaggctggccgccccccaatcaaagcggctgccttcccccagccctgacggtaaagtgctcatcgtgatctcaccggcgtggacagcgcccgccagcaacgctgccgccatgggacagcatgcgcgcatcctcatcatccgcatcgctcctcgcttattatcgttctggcggcgccggacgccggcgccgcgcgtcagccggctatttcaggtaggcctcggccagcttcacccaatagctggcgcccaggctgaggatgtcgtcgttgaagtcgtaacccgggttgtggatcatgcagccgcccttgctgccgacgccgttgcccagcaccacgtagcagcccggcaccttttccagcatccaggaaaagtcgtcgccgcccatcgcgccggccggcagcggcacgatgccctgcggccccaccatgccctccgccacctcgcgcgcgatgcgggtttcctccggcgtgttcaccagcacccgcgtcaccggtttccactcgatgcgcgcctccactccatagctttgcgcctgcagcgtcaccagttcgcgcagcctgccctcgatctggcgctggatggcggagctgtaggcgcgcaccgtcaactccagttgcgcgcaatcgggaatcacattgctggcgctgccggcatgcgccgaaccgaccgtcaccaccgccggctggtccggcgccagattgcgcgagactatggtttgcaaggacaggatgatggatgccatcgccacgatgggatcgacgcaggtgtgcggcatgccgccgtgtccgcccttgccggtgagggtgatggacacgatgtcggcggacgcggccagcacgcccggttgcacgatgaagctgcccaccggcaaagtggggccgttatgcatggcgaacaccgcgtcgcaggggaagcgttcgaacaagccttccgccatcatccgcgccgcgccgccctgcccctcttcggccggctggaaaatcaggttgagcgtgccgtcgaaaccgcggctctcggccagatggcgcgccgccgccagcaacatcgcggtgtggccgtcgtggccgcaggcgtgcatcttgcccggcagcttgctggcgtaaggcaggccggtttcctcgtgtatgggcaaggcgtccatgtcggcgcggatgcccaggctgcgcgcgccgctgccgcagcgcagctgtcccaccacgccggtgccgcccaggccggcggtcacccggtagccccaggctttcagcgattccgccaccagcttgctggtggcctcctcctcgaagcccagctccggatgggcatggatgctgcggcggatggcgatgaactgttcttcgtgctgcacgatggcgggaatgacccccggcagtttggacatgtcttctctccgtttccatcaggtgggaaaggcggcgccggcagaagaagatgccggccacgcgcggcgccgctccgacaccagtctatgaacggagcaagcatgaggaaggggggaaaatggccattcagcgggctgatatcgccagcctgccgaactgcggagcttgacggcgggcgccgcctcaaatctgcataaagaataaataaatcagaatcaacatgccaacaggcttgaatttgcgcgccgctttcgccaaggttaaagcggatatcgccaaggttgccccggatgaacacctgcatagacctgctttgcctgcccaactgcctgagcggaaccttgttttccgccatcgacgcgctgcaggcggccaataaactgtggcatctgcgccacccgcggcagaaatcgccgcgcttccaatggcggttgctggacgcaagcggcgatccgctgccgccgccgccctggctcaacgcgccgacgcccgccgcgccggccagcggacaatcggcgctgctggtgccgggcctcgacatggacagcgtcccccatctgaaacagcagctggagcaatgcggcccggcgctgcggctgatcgcccgccgccacgccgccggcgatgtcatcgccgccaattacaacggcgccgccatgctggcccgcgccggcattctggacgagcgcaacgccaccatcacctggctgatcgccggctggttctccggccagcatccgcgggtgcggttgctgatggaccggccggtcagcgtggacggcaacatcttgtgcagcggcgcgccggcgtcggccaccgatctggcgctggcgctggtgcgccatttcgccggcgacgagctggcgcaaagctgcggcaatggcctgctgtaccaggcggcccgtttcgagcagtccggccagaccctgcccctgctcaatacacctacccgcgacagcgcggtattcaaagcgcgccgctggctggagcagcacgtgaccgagccctaccggctggaccaggtggccgaagccgccgcggtgagcagccgcaccctgctgcgccacttccgcgaagtggccgacatgacgccgctgcaatacctgcagcaattgcgggtggaaagggccaagctgctgctggaagtcaccaccgtcgatttgtccggcatcgtcgagcagtgcggctacgaggacgccgcctccttccgccggctgttccgccgccagaccggccttacccccaccgcctaccgccgcgcccattctttgcgcgcctcccggcgctggtggcgggcgggagacgacattcccgccgccgcgccgggcccgctcacggcgtgacgcgcatataaggcgtagtggtcaaggtggcggaaatcgcgcagccgccagtcagcggcgccgccgccaggcctatcgtggtgtcgctgccgctgtcagttatcgtcccggctatccggctgggcccgcattgtccgcccaggatcggcgtgttcacgttcaccatcaccccgtctatggccaactggttctgcgccgtcactcggcccacccagggcgcggacgcggtggcgctggccttgatcatccggcacaccggaatgcccttgaaggcggcgctggtgatcaggatattgccggcgccgtccaccgtgccgctgaacacggcgctgcagtcgacatccacctcgcccttgctaaccgtggccggccccaccgcggaaaacggaatggctgccccgcccgcgcccggcggcgtgatcgtcgccgcgcccgccgccgaagacatcatccacgccagcgcgcacgcgccggccatcgcaagcttgttcattgtgttcatcgaaattttccgtcttgtttggtttggaatgcggcccggagcgccaggccgcgggcgaaagattaaaatgccaacaacatggtagatttgacccagatcagcagcgcctgcgccgctagttcgcgcctgcctgttgggccagttggcgccgccggcttgacattacggctggacaccagacatgatgaagacatgaaaacctgccgattccaccgccaccaccatcacggcctgccccagggcgccggggcgccggggcggcgcgcggtcgtcgggaggaaagcgcgagctgacccatccgtcagccgcaaaccgcacaggcgccgcaaggcgccttttttatcgcccgcgcgcaagacgcgctgaaaggaaacaccatgaccatgatccgaggcacccgcatcgtcgccggccgcgaggccgcccttctgcgccaattggaaaaccgcttccggggctggcttcattgacgccggcgccgacgaagccatcctgcccgcgctgtggggacaggacacctttgtcgcaaaggccggcggcagcgaaattctcgaacagatgtgggcattccccgaccgcaagggccgcgcctgctgcctgatcccggaagccaccgcgctgtttcaggagaaaaaccgggaatttctcaacggccggcgcgaggccagtttcttctacgtcgcgcgctgctatcgctatgaaaggccgcaagccgggcgctaccgcgaattcacccaactgggcttcgaatgcctggggccggacccggccgccgcgcgggagcgcagcctggcgctatgccgctgctttctggatggactggggctgcgctatcagctggacgcttcggcgcgacgcgggcttagctactacctgggcggggaaggcttcgaaatgcgcgtgccggagttgggggcgcaaaaacaggtagtcggcggcggcgcgtaccgcgaaggcgccggcttcggcatagggctggagcggctggcgctcgcgctggcggcgcagacatccagccgtgacggcgtaaaaaaggccgggcgtctgcccggccttgcgatgcctgctcaggctcagacgccggtgccgccgaccgtcaggccgccgtcgatgcgcagcgtcggctggcccacgcccaccggcacgctctggccttccttgccgcacacgcccacaccctggtccaaggccaggtcattgcctatcatcgacacgtagttcagcacttccgggccgctgccgatcagcgtggcgcccttgaccggataggtgagcttgccgttttcgatgcgccaggcttccgacgccgagaacacgaacttgccgctggtgatgtccacctggccgccgccgaaattcaccgcgtacaggccatccttgactgaagagatgatttcctgcggatcgcgctcgccggccagcatataagtgttggtcatccgcggcatcggaatgctggcgtaggactcgcgccggccgttgccggtggaggcctcgcccatcaaccgcgaattgagcgcgtcctgcatatagcccttgaggatgccgtcctcgatcaacaccgtgcgctgggtggggttgccctcatcgtcgatggccagcgcgccgcggcggccgcccatcacgccgtcgtccaccacggtgacgccggaggcggcgacgcgctgccccaccatgccgctgaaggccgacgtgcccttgcggttgaagtcgccctccaggccatggccgatggcctcgtgcagcagcacgccgggccagcccggccccagcaccacggtcatctggcctgcaggcgccgggcgcgattccaggttgaccaacgcctgcttcaccgcttcgcgcacatagcgctccaccaccgcgtcgtcgaaatagttgaggtcgaagcggccgccgccgccggacgagccctgttcgcgccggccgttctgttcggcgatcaccatcaccgacacccgcaccagcggacgcacgtcggcggcgcgcacgccgtcatggcgggcgacgtagaccacgtcgtattcggtggcgaggccggccatcacctggatcacgcgcgggtccatcgccttggccaggcgttccaccttttccagcaaggccaccttgccggcggcctccatgctgtggcaagggtcgatcgatggatacagcgattgcggcttgcgcttctccaccgcgccggcgctgccgtcgccgccggtccggccgatggcgcgcaccgcctcggcggcgcgggtcagcgcgtcctggctgatggcgtcggagtaggcgaaagccgtcttctcgccggacaccgcccgcacgcccacgccctggtcgatgctgaagctgcccgacttgacgatgccctcctccaggtgccaaccctcgttgcgggtgtactggaaatacaggtcggcgtagtcgatatcgtggcggcgcatatgcgccagggtctgctcgatggcggactcgtccaggccgtaaggcttgagcagcaattcatctgcggcggtgaaggcatcttgcatcggtattctttcaacgtatgactcggtgctccagcgccggcaggctgctgcgcaccgattggatcaaatcggggtcgatctcggcgacgatcacgccctcgccctgcggcagttcggccagaatgcggccccaggggtcgatgatcatcgaatggccatgggtcttgcggccgttttcatgcacgccgccctgggccgaggccagcaggtagcattggttttctatcgccctcgccctcaatagcggctcccagtgcgcctcgccggtggtggcggtgaacgccgccgacatgatcagcaagtcgaacggcgccagcagccggtacagctcggggaagcgcaagtcgtagcatatgctcagcgcgatgtcggccagcggcgtttccgccttcaccggcacgcagcccgcgctgatggtgttggattcgcggtagctctcgccctggccggtgaagccgaacaggtggatcttgtcgtagcgcgacaccacctcgccctgtggattgtagagcagactggtgttgagcaccttctccggattatcggcggccagcggcaccgtgccgcccagcagccacacgccgttggcgcgggccatgtcggacagcgcctgctggatcggcccctcgccataggcttcgcgcagcgccaccttgtcggtctcatgcgcgcccatcaggcaaaaatactcgggcagcaccaccaggcgggcgcctttgccagcggcttccgccaccagttcggcggcgcgggccagattggccgaaggattgcaaccggacaccatctgcacagcagcggcgacgaacttctgcttcatggttttttccccttgatgttgaccggatcgccgacgttcaccctcaccacctgcgggtccttcagcgaaccgctgactgcgtaatcgagcgacaggatttttcccaccgggtcttgcaacaccttttgcgccgccagggtggcgatgcccaccaccggattgagcaaggccgcgccggccgccagcgccacgctttccgccacatgcggcaccacatgcactttcagcgcctgggtttccttgcccaggtccacttcgccggagatggtcacctccgccgccgggcttctcatctccaccttgctggaggtgaacaggccattgcgcacgccggccgcgccttgcagcgtatcgaacgcgaagccttcgctgaagacgtcggtgaaatccagccggatccggcgcggcagcgattgcaggctgagcacccccaacagccgcgccacgccgggatccaccttggcgaagcggccattcttgaaatccaggctcagctggcctgacaagtgggccgcgtccaggtcgctgaggccgccgggccagttcagctggccagacagcttgccctggccgttgcggaacacgtctccctggccgaagcgggccagcagcttgccggcgttggcggtttccagcgcgaaacggctatccacgctgcccgcgccctgttcgttgacctcggcgctgccggacaggctgccctccggcgtggtcagcttcagcgggtccatgatccagactgcgccgtcgcgccgcgccgtcatgtccagcttgccgatttcccgcccctgcagcgatagctcggcgatatggatcttcatcgccggcagctgcggcttcgccgccgcgccaggcgtcggcgccgcgtcggggcgcagcggccagttcaaggccagccggtccagattggcctccagcgcgccgcccccgcccggttggtagctgaccagcccggtggcctcgcgcgagcgcagcttcaccgaccacagctccgttccgggccggttgaaaacgtgggcattcacctgatgcagcgtgaagccttgagccgacagctcgggcgcgtccagatcaaaggacaatatcatatttccgtttgacagcccatcggcgccgcccagccgcgacagccgctgccaccagtcgtccagatccacccgcgcctgctgcgcgcgcaacgccaggcccgtcgccggccattcgccggcatcgcgctccagccccagcgcgccggcttgcagattgccatgctcatccagccgcagcttgccgttcagcgcggtgcccagcgcgaattccagccgcatcgcctggccgaagcgcgccggggccggatgcagctgcaactgcaaggcctgcgccgccgcggcggccttgcccagcggcggcggcgcatccagcgccagcccctgcaggctggacgacagctgcaggctctccaggccgtcgcgcaccacgaactggctgtcgaagcggctgcgtccctcggccagcggcgccaacggcgccaaatattgctgcaagactcgtttgccgtccgcctcgccccccacctcgaagcgcatgcgcttgtccgcgccggtatgggcgctcaggcggaaagcgccgccgaaggcttccatggccacgcccttgctgtctatgccgcgctcggtgaaggtcagccggccctgcaccgccgtcaactcaggcagcggcagttgggtgaacaacagccggttatgcttgaaatcgatatcgccgcgcaccttggtgctgtcctcgccggccagcggcaccgccagttgcagcttcagcgcggccgggccggcggcgcggatcttgccggtgaagccgcccagccagccatccaccgggctcttggtggtgaaggccagcatccggtccagcttgtcgtcgatctctccctctatcttcagccacggcgccgtcgcgcccagctggtcgattcccaccctcacctggcgcaaaggcacgccgaccgtgctggcgcgcgtgctttccacccgcatcgcctcgttatggaaagtcagcttggcgtcgatatcgtcaatggcgggccagcccggctgatacagcagcttggctttttcaacgtcggcctccaccaggaattccccgcccttgcctgccgggaaggggaattgatccagatcgcccttgagcgtcaagcggacatttttcgccatcccgtccagcagcgccttgcgcagccaggcgctggtatgttcgcctacttggtgcggcagataggcgggtatgcgcgtcgccttgacttcgtcgaccgaggcggtcaggtcgatatggccggcgccgccgccgccatggtggtagctgccctgcagcctgccggcgagatcggcgttggcgaaggccagcttgtcgaagtcgatgtccagcgccgcgccgcgctggcgccaggaaatgtcggccgccaggctgtcgaaaggcagactctgcgcgtacaaggccgggtagatcacttcggacttgccggtgtccagttgcaagcggccgccctgctcgttgaaatctatgctgccggtgacgccggccacgcccggcaagtcggcgaacggctgccagcccaacgcttcgaaacgggttttcagctggaagctgcgcggtgcctccgccggcccctgccagcccagggtcaagccatgcagcgcgccgcgcggcgaaaatcgggcgaacagcgggttggcgtccacgccgagggcgcggatgaacgggttcagatggccgacgtcgacattgtccagcgtcagctcgccgccgccttgggcgccgggacgccactggcccttgatcgaagacttgtcgaaggcgaggccggtggcgctggccagggtcaggtcgctggccaggatcttgtagctgccgtcgccctggcggtccaactgcagcttgccctgcagctgcggcaacaccagctcgcgcgcgctgggcggggtataggcggcgttgcgcacgttgacgtccgcccgcaggctgccgatgctgccgtcggcgaacgacatttccagcgtgccgtcgccctcgccgctgcgcagcacccccatctcgcgcatatagcgcgaccacacgtcggcgcgcgcgccgttgagcgccacccgcagcgatcccgaccactgcagccagctgttgatgtcgtcgccgcgccagctggcgtccagctcgaagcccttgcccagcgtggcggccggcaggccggccagatgcagccgatggcccagcaaggtgcgttccagcagcaactgtccctgcttcaggtccagccggggcaggcccagcctgtcgtcctgccagctcagccgcgcgttgcggatgtccagcgaaagctggcgcagcagccagttgcccagcgcgttgtccgacgacggcccgctgctcagatcaaaaccattcagatagatcaccccggcggcggtgcggcgcagctccaccgccgggccgttcaccagcaccgacaggcgcggctcccaggccagcatcgacgtccacgacggctgcaccgtgaccaggctcagcgtcagcgcctggccggacaccgggttggcgatcgccaccccgctcagttcgaacaacggcgccacgccttcccaatggccggacagcttggcgatgcggacatcgtgccccagcgcgccggacaggctttgctccagcctggggcggtattgatcgagattcggcagcagccagaaggtgaacgcgcagaaagcggcggtcaacaggacgcagacagtcgacagcagcagcgccagaacgagcaggctgcgcttgagcacgcgcaagacgtgaatgcgggacaacggcaacaagggctttttcaactatggcaaaccgttacaatgacgcggtgaaagatacggcgacgaaaaccggccacagcccgccctccgcgcggccgttattctgccgcgctaaaccgtccggagccattatgccagcaaacacggccgctgccattgcccgcagctgcgagttttcccactatctgacccgccttctggcggcccggccggaagaaggcgagcggctggagcggcagttgagccagcccttcaccgttgaggatatgcaggacttcgccgactggccagccctgcaggcgccggaacagctggcgcctgcgctgcgccggctgcgccaggcggtgatggcccgcctcatctgccgcgacctcaacgacctggcgccgctggacgaggtggtcgccaccatcagccagctggccgaattcgccgtgcgccaggccttgcgctgcgcctgcgcctcgctgccccaatacggcaagccgataggcgaggacagcggcgaggagcagcagctgatcgtgatcggcatgggcaagctgggcggcggcgagctgaacgtcagctccgacatcgacctgatcttcatctaccctgaaagcggcgaaaccgacggcgcgcgcaagatcagcaatcacgaatatttcacccaggtgggcaagcggctgatcgcgctgatccacgacctctccgccgacggccaggtgttccgggtggacatgcgcctgcgcccctacggcgactccggcccgctggtgatgagcttcgccgcgctggagaactacctgctcagccagggccgcgaatgggagcgctacgcctggatcaaggccaaggccatcaccggcgacgccgaagggttgaatcagatggtccgccccttcgtctaccgcaaatacctggactacaacgcctacggcgcgatgcgcgaactgcacgcgcagatccgccgcgaagtggcgcggcgcgacatggccgacaacatcaagctggggccgggcggcatccgcgaggccgaattcatcgcccaggtattccagctgatccgcggcggccgcgacaagacgctgcaattgcgcggcacccgcgccaccctatcccggctggccgacctgcggctgctggagccgtcggcggtggaagagctgcaagatgcctacgccttcctgcgcaagctggaacaccggctgcaatacctggacgaccagcagacccaaaccctgccggccgcgccggaaacccggcaaaaaatcgccgccagcatgggctacgccgactgggacgccttccagcccgcgctggccgaggtgcgccgcaaggtcagccgccacttcgagcaagtgttcatcctgcccagcgaggacagcccggaccacccgctatcggaattgtggctggacgtggccgaccaggacccctcgctgcggctggcggagctgggctacgccgaccccgccgccgtggcccgccagctcaagggcctggcgcaaagccagcgctacctgcagatgccgctgtccggccgcaagaagctggacgcgctgatgccggcgctgatcgaggtggcgtcgcgcttccccaatgccgacgacacgctgtcgcgcatcatcggcctgatggaagccatcagccgccgcgcctcctacctggctctgctgaccgaatacccgcaaacgttgcagcggctggcatccctttactcgtccagcgcctgggtgtccgcctacctcagccgccaccccatcctgctggacgaactgctggatgtgcgggtgctgtacgccgcgccggactggccgctgctggccagccagctggaagctcagctgacgcaggccgacggcgacgtggaggccaagatggacgcgctgcgccatttccagcacgcgcagaccttccgcctggtggcgcaggacttggccggcatgtggacggtggaagcgctgtccgaccagctgtcgctgctggccgaccacgtgctggacgcggccgtgcgccacgcctggctggacatctccagccgccaccagcagacgccgagcttcgcggtgataggctacggcaagctgggcggcaaggaactgggctacgcgtccgacctcgacatcatctttctctacgacgacccccacccggacgcggccgaactgtactcgcggctggcgcgcaagctgtccacctggctgaccagcgccaccgccgccggcgtgctgtacgacatcgacctgcggctgcgccccaacggcgccagcggcctcttggtcagctcgatctccgccttccgccaataccaggaaaaccaggcctgggcatgggaacaccaggcgctgacccgcgcccgcttcgtcgccggcgacgaagccatcggcgagcaattcgaagccgaacgccatgaaatcctgacgctggcgcgcgagccggccaagctgcgccaggaggtgctggacatgcgccagcgcatgctggacagccacccggcgcggccagacgacgtgaaaaacgcccgcggcggcatcatagacatcgagttcatcgtccagtacctgatcctggcccacgccagccggctgccggctttcaccggcaacaccggcaacatcgcgctgctggcggtggcggccgacgccggcctgatagaccgcgacctggccgacggcgcccgcgccgcctaccggctataccgccggcttcagcacgcggcccggctcaacgagcggcagaaagtggaagtggacaataccctgctggccgcctatcgcaagggttgcctgttgtggcaacaggttttcgagcaagcgctcgatttttcctgacgccgggttcacaagtccggcggcggcggtatacactgccccatcaagcaaggctaaaggcgcggccggcggagttgcctggacagcgcgcccggataaagcacaacacaggagagtaccgagatgtcgatggctgatcgtgacggatatatctggtttgacggcaaattggtggactggcgcgacgccaccacccacgtcctgacccacaccctgcactacggcatgggcgtgttcgaaggcgtgcgcgcctacgaaacccccaagggtccggccattttccgcctgcaggaccacaccgagcgcctgttccgctccgccaagatcctgggcatggcgctgccgttctcgccggaacagatcaaccaggcgcatctggacgtggtcaaggccaatggcctgaagtcctgctatttccgcccgatggccttctacggctccggcaagctgggcgtggcgccgctgaagaacgacgtgcaggtgatcgtggccgcctggccgtggggcgcctacctgggcgaggaaggcctggagaaaggcatccgcgtgaagaccagctccttcacccgccatcacgtcaacatcaccatgtgcaaggccaaggccaacggcaactacatgaactccatcctggccaataacgaggccaccgccgacggctacgacgaggcgctgctgctggacgtggacggcttcgtcgccgaaggctccggcgaaaacatcttcatcgtccgcaagggcaagctatatactcccgacctgaccagcgcgctggaaggcatcacccgcgacaccgtggtgcagatctcccaggaaatgggcctgcaactggtggaaaagcgtatcacccgcgacgaagtgtacagcgccgacgaagccttcttcaccggcaccgccgccgaagtgacgccgatccgcgagctggatcgccgcccgatcggcaacggcgcccgcggcgcgatcaccgccgaaatccagaagcgctacttcaacatcgtcaagggccacgacgccgaacacgaacactggctcacttacgtaaaataagcggtagaatccgcaccacgcgcgccagcagcgtgcggccccggccgccctgctggcacacgtttttcggacgccccgcttgccgcaacaaggaatgaccatggcagaactcaaagaaaacaccgcacgctatattgaagtcacccagcacgacctgccgctgcactgcccgatgccggacatgaaagcctggaactcccatccgcgcgtctacctgccggtgcacaaaaccggcgaagccctgtgcccctactgcggcacccagtacaagctggtcggcccggtcggccaccaccactgaagcgccccgcttcgccgggacacaagggtgtggcgccggccacaccttttttgcttgccgacgccaaacgcaagccggtatgcccgcagccggcttgcgtttggaaccggaaacaccccatgaagaaaaaaatcctggtcatcggcccgtcctgggtcggcgacagcgtaatggcccagccgctgtaccgacgcctgcaccagcgccaccccgagctggagctgcacgtgttcgccccagcctggaccctgccgctcttggcgcggatgccggaagtggcccaatcccacctcaaccccttcggccacggcgcgctgcggctgatggagcgctggaaagtggcgcgccagctggcgaaggaaggcttcgaccaagtcatcgtgctgcccaactcgctgaaatccgcgctgatcccgctgttcgccggcattccgctgcgcaccggctttctcggcgaatcgcgctacggcctgctcaacgacgcccgcgaactggacgaacaggaactgccgatgatggtggagcgcttctgcgcgctggccgaagacaagaagcgcccgctggcccgccccattcccaacccgctgctcagcgccgatgccgcctcgcaacagcaggccgcgcagcgcttgggcctggacaccggccgcccggtggtcgccttctgccccggcgcggaatacggcccggccaagcgctggccggcgcggcacttcgccgaactggcgcgccgcttcgacgccgccggttacgcggtatggctgttcggctccggcaaggacaaggatatcggcgacgagatcgccgggctgtcgcaaggcagcgccgtcaatctgtgcggcgccaccggcctggaagaagcgatagacctgatcggcctgtgccagctggcggtctgcaacgactccggcctgatgcacgtcgccgccgcgctcgacaaaccgctggtggcgctgtacggctcgtccagcccggacttcaccccgccgctgtccgacaaggcggccatcgtgtcgctgaacctggactgcagcccctgtttcgagcgcagctgcccctatggccacaccgactgcctgaaaaacatgcagccggacatggtatggcaggccgcgcaaaccctgcttgccccgccctccaaccagacccgggactgaaatgagcgccgcggaaaccccgaagcaacccgaagagaacacccgccgcatggagctggtgcgcgcggccgctgtgctgttccgcgaccagggctatgagcgcaccacggtgcgcgacctaggcaacgccgtcggcctgcagtcgggcagcctgttctatcacttccgcaccaaggaagagatcctggtggcggtgatggcgctgggcatcagcagcaccaccgagcaactggccgccgccatctcgcaggcagacagcccgcgccagcgcctggcggcgttgttccaggtccacctcaactccttgctgggcgacaaccaagccgcgctggaagtgatgctgtacgaatggcgcagcgtgtcgccggcggccaaacccgccctggtggtgctgcgcgaccgctacgaggcgctgtggcagcaggtgctggacgaagccgcgcaggctgggttggtgaagcaggacacccgcctgctgcgccgcaccctgctgggcagcctgcactggaccgtgcagtggtaccgccgcgacggcgaactgagcgtggatgcgctcgcgcaacacatgttgcagctggtcttgctggaagcggacgcaaaaacttccaccgaaagataaaaagtgatctaatatcagcgatataggaacattgggactgtagccatggcaaacatcgccagcgtaggcaaccccgcgacgcaaccgctctatgccgggcaaacgccccggcaggtgcagtcgtcgctggacaatgcccagcccgccgttcagcaggcctccagcccgccgcagacccaggtagccgtccggcagaatccggacaccgcccgggtcgagcaacagctgcagcagcaattgagcaatagccgcagccagcaggccctgcaaaacgcccaggcccagaacgccgccgccaacgccgcgccggccgccccccaggcgaacccggcccagatcaacaactccgcggcggtgctcgccaccaacccgcaaccggccgccgcggccgccgtcgcccccgcagtcaacggcaacacggcgcctgccgccgcgcccccgcagcaggccggcaacaacaacgctgcggcgcaggccaccccgacgcaaaccgcgcaagccccctcccaggccgctcccgcgcaacaggcggccacgccgccgcaaccggccacgccggcgcaaagcgccaccgcgccctcaaccctggcgacccaggcggtgaaccgcgcgcagcagctcaccagcagcggccggcaggagttgtcgcaataccaagccactcaatcgctgctggagcccagcgtttccagcaccagcatctccaccaccgcctgatccggacgcaccggacaagcgaaagccccgcggacgcggggctttttccttgccgccggctgcgctcagcgccgcttgccgcctggcttgcgccgcatcggctcgccgccgcccctgcccttgcgcttctgcgaattctgcacctgcagcagcgcgtcgatgcgctccgaggtgctctgcatcaacagctgcgccatttcgccgtccgggaaggtgtccggcatccggtaagacagccaggcataagcggcgtacagcttgcagctgtcctccagatactgcaactcgtgccggccgccgccgcccagcatccgcaacagcggcgcggccttgccgcgggcgcggtgctgcgcccagtcatgcagcgccgtctccagcatcgcgatcttggtggagaccgggcacaggctgaaggtgaagcggtcggccaggctcaacggcaaggcgtccagccattcggccttcgccatctgctcggacagattggcgggcaggaagaattcatcatgcacattgatatggcgggcgaacaaacccagcagcgccttgagcttgccctcgccagtggcctcggagatcgcctccagatacttcaggcccggcgccacgaaaaagccgctctcgggcaagggctccggcttctggcgcagcaacgcggcgatggtcttgtgagtctggccgtcgaagccggcgacgtagccggtttcatgcttgccgaaacgcccggcgcggccggcgatctgcttggccagaggcgcggcgaccacgccttcggcgtagccgtcccacttgctggcggtggtgaagatgatgcgccgcgccggcgtgttcaaccccataccgatggcgtcggttgccaccaccacctgggtttcgccgctgacgaagcgctcggcctgcgattgcctcacctccggcgacaggttgccgtagatggccgacaccgatagcccctgctcgatcaccttgtcgcgccagttcagcacctcgcggcgggaaaaggcgatcagcacgtcgccgggccgcaggttcttcaacgacaacagcggcgccttgtccatctgcagcgcggtcttgcgctccagcgtccgcacttccagcgtgccgccgacgcgcgccaccagtgactcgatcgcctcgcgcgattccggcgcgcccaccaggtagatggtctgcgccggcacgccgcagacggcggcggtccaggccgcgccgcggtccgggtcgtccaagagctggatttcgtcgatcaccgccacttccacctgccgctccggattcagcatttccaccgtgctggcgacgtgggtggcctccggatgcagcttgcgctgctcgccggtgatcaggcttaccgccacgccggcttgctgcaaacgggtgtagttttccagcgccaaaaggcgcagcggcgccaggtaaaccccgctcttggctttttgcagatgctccatcgccgcgtgggttttgccggaattggtcggccccagcaccgcgatgaaatgtcgctgcatcgcgtaggcggtggcgaaagattccgggtagcgcgacaggttgaccgcgtcgcgggttttggcggcggccttgtcggcgctctgccggctgcgcgcggcggccacccgatccagcgccagggtgcagcgcaccttggcgcgctcgtacttcgccatgaaggcgctgagcgcgcgcaacggttcgatgccgtccaccgcgaacacttcgcgcgcgcaagccaacagctgctcttccagcttttgccgcgcggcatcgttccaacgttcccgcaccagcgccagccgcgcttccgcgtccagcttgcgccacttggcgctcttgcccaggaagccttcgtccggcaccaggtggtagggaatggcgtgaccgttcagcgccagctcgccatgcaccgacaccgcgtggctgccctcggtggtgacgatggtggcgttatgcgccgccaggtagtcgtccagcaggatttcgggcggcaacgcttcgtggagatcggtcatggcggctttcttgttcagggctgaaggggggcgatgatagaacagccggcggcgatgcgccagccgcgcctcctatcaaaatccgccatcgccgccgacaaggcaagcgccacaaacaaaacaggccgccgatgcgcggcggcctgcgggacagagaaacggcttagatcaattccactgccagcgcggtggcctcgccgccgcctatgcacaagctggccacgccgcgcttgccgccgcgctgtttcagagccgacagcagcgagatcacgatgcgggcgccggacgcgccgatcgggtggcccagcgcgcaggcgccgccatgcacgttcaccttgtcgtgcggcagcttcaggtcgtgcatcgccgccatcgtcaccacggcgaaggcttcgttgatctcatacaggtctacctcgccggccttccagccggtcttggccagcagcttttcgatggcgtgcaccggggcggtggtgaaccagcccggctcgtgggcatagctgctgtggccgacgatgcgggcgatgggctgcaagctgcgcttggccgcctcggccgccgtcatcagcaccagcgcggcgccgccgtcggagatggagctggaattggccggggtgacggtgccgtccttcttgaatgccggcttcagcgtcgggatcttgtccagattggccttcagcggctgctcgtcggtatccaccacggtatcgccgccgcggcccggcacggtgaccgcggcgatttcgtccttgaactggccgcccttgatcgcctgctgcgcgcgggtcagcgaggcgatggcgaattcgtcctggtcctggcggctgaagccgtacttctcggcgcactgctcggcgaacacgcccatcagcgtgcccttctggtaagcgtcttccaggccatcgaggaacatgtggtccttgatctcgccgtggcccaggcgcagaccgccgcgcgccttgggcatcagatagggcgcgttgctcatgctttccatgccgccggccaccaccacctggccgttgccggccagcaactggtcatgcgccatcatcacggccttcatgccggaaccgcacatcttgttgatggtggtgcacggcgtagcctgcggcaggccgccgcccagcgccgcctggcgcgccggcgcctggccctggcctgccggcagcacgcagcccatgatcacctcgtccacctcgccggcggcgacgccggcgcgttccaccgcggcgcggatcgccgccgcgcccagctggccggcggtcaaaccggacaaggcgccctggaagcctcccatggcggtgcgcgccatgccgacgatcacgatttcctgttgttgcatcacagctccttatgcttggttgtggccgttggcgcgcttgcccagcgatttttcgcactggccgcgcaattggccgatttctgtcagcaccaccttgatgtcttccatctgcgccaagagctgctgctccttgcgcgccaggatgcggatgaattcctgcagctgcggcgcgtcgtcgcgcgccgcgtcgtacagcgcgaacagctcgcggatttcctgcagggacaagccgatgcgcttgccgcgcaaaatcagcatcaaccgcacgcggtcgcggcggttgtagatgcggcgctgcccagcccgctccggcaccaacaggccctggtcctcgtaaaagcgtatcgcgcgggtggtgatgtcgaactcctgcgccagttcggtgatgttgaaaacctgctccgccatgaatgccgctccctgctgtcgctctgcggccatgggcgccacagttggctggtttatgctcattgtctgttgacgttgacgtaaacgtcaagttatcgtgaccacaatagagcaaataatccaggagagccagatgagcaagaaaatcggtgtggtgggcgcgggcaccatgggcaacggcattgcccaggtcttcgcgatgaagggcttcgaggtgctgctggccgacgtcagcgacgccgcgctggtgaaaggcatggccaacatcaatatcagcctgcagcggatggccaagaaagaactgatcgccgaggccaacatccccggcatcgtcgcccacatccgcgccaccacccagctggccgatctggccggctgcgacgtggtgatagaagccgccaccgagaacgccgccatcaaggagcagatcttccgcgatctggacgccgccgtcggcgaaaagtgcgtgctggcctccaacacctcgtccatctcactcacccgcatcgccagctgggtcagccatccggaacgggtggtcggcatgcacttcatgaacccggtgccgctgatgcagctggtggaaatcatccgcgcgctgcaaaccggcgacgaggcctacaacaccgtgttccatctgtcccaggcgctggacaagaccccggtgacggtgaaggacggcgccggcttcgtctccaaccgcgtgctgatgccgatgatcaacgaagccgccttcgcgctgtatgaaaacctggccaccgccgaagacatcgacaccgtgatgaagctgggcatgaaccacccgatcggcccgctggcgctggccgatctgatcggcctggatacctgcctgtccatcatggacatcctgcaccgcgaattccgcgacagcaaataccgcgcctgcccgctgctggcgcagctggtgcaggccggacacctgggccgcaagagcggcaagggtttctatagctacaactgagcagcgccatcagcccgaacactatagaggaggcagtgccatgagccagtcagtacccagcgtcaaactgttgatcggcggcgagttcgtcgaatcccgcaccacggaatggcgcgacatcgtcaatccggccacccaggaagtgctggcgcgcgtgccgctggccaccgcggacgaagtcaacgccgccgtcgccgccgccaaggaagcgttcaagacctggaagaaaacgcctatcggcgcccgcgcccgcgttttcctgaaataccagcaactgatccgcgagcacatgaaggagctggccgccatcctcaccgccgagcagggcaagactctggccgacgcggaaggagacatcttccgcggcctggaagtggtggagcacgccgccaatatcggcacgctgcaaatgggcgaatacgccgagaacgtcgccggcggcgtcgatacctactcggtgctgcagccgctgggcgtgtgcgccggcatcaccccgttcaacttcccggcgatgattccgctgtggatgttcccgatggccatcgccaccggcaacaccttcgtgctgaagccgtccgagcaggacccgatggtgacgatgcggctggcggagctggcgctggaagccggcattcccaaaggcgtgctgaacgtggtgcacggcgcggcatcggtcgtcgacgccatctgcgaccaccccgacatcaaggcggtgtccttcgtcggctccaccaaggtgggcacccacgtctaccagcgcgccaccctgtccggcaagcgcgcgcaatgcatgatgggcgccaagaaccacgctatcgtgctgcccgacgccaataaggaacaggcgctcaaccaattggtgggcgcggccttcggcgccgccggccagcgttgcatggcgctgaccgtggcggtgctggtcggcgaggcgcaaagctggattccggagctggcggccaaggcgcgcggcctgaaggtgggcgccggcaaggacaacctggacctgggcccgctgatttcccgcgccgcccgcgaccgggtggaaggcctgatcgccaagggcgtggaacaaggcgccaagctggagctggatggccgcggcgtgcaggtggccggcttcgagcgcggcaacttcgtcggcccgaccatcttctccggcgtgaagccgggcatggccatctacgaccaggaagtgttcggcccggtgctgtgcctggcggcggcggacaccttggacgaagccatcgccatcatcaatgccaatcccaacggcaacggcaccgccatcttcacccaaagcggcgcggcggcgcgcaagttccaggaagacatcgacgtcggccaggtgggcatcaacgtgccgattcctgtgccggtgccgctgttcagctttaccggcagccgcgcgtccaagctgggcgacctcggcccctacggcaagcaggtggtggctttctacacccagactaaaaccgtcaccagccgctggttcgatgacgaagccagcatgggcaaggtccacaccaccatctcgctgcgttgattttccgcagggcggacacgcgcgtccgccctgccaccgattgggaatggaatatgaatttcgaactgaacgaagaccagatcgccttccagcaaagcgcccgcgacttcgccgagcgcgagctggccccgcacgccgccgaatgggacgccgaatcccacttcccgctggacgtgatccgccagagcggcgacatgggctttctgggcctgtacacgccggaaacctacggcggcttgggcctgccgcggctggactccgccatcatattcgaggagctcgccgccggctgcacctccaccgccgcctacctgaccatccacaatatggtcagctggatgatagccagcttcggcggcaagcagctggccgaacaatgggtgccgaaaatggtgaccggcgaagtgctgggcagctactgtctgaccgagccgggcgccggctccgacgccgcctccttgaaaacccgcgccgagaaaaagggcgaagtttacgtgctcaacggcggcaagatgttcatctccggcgccggcagcacccaggtgctggtggtgatggcccgcaccggcggccccggccccaagggcatctccgccttcgtggtgcccgccgacgcgccggggatcagctacggcaagaaggaaaagaaaatgggctggaacagccagcccacccgcgccatcaccttcgacaacgtcgaaatcccggtggagaatcgtctgggggaggaaggccagggcttcgccttcgcgatgaaaggcctggacggcggccgcatcaatatcgccacctgcgccgtcggcaccgctcaagccgcgttgaacgccgcccagcgctatgtgcaggaacgccaacagttcggccagccgctggccgagctgcaaaccgtgcaattccgcctggccgacatgctgaccgaactggtggccgcgcgccagatggtgcgcctggccgcctggaagctggacagcggcagcgccgacgccaccgcttattgcgcgatggcaaagcgcctggccaccgatttgagtttcaatatcgccaacaacgcgctgcagctgttcggcggctacggctatctgcaggacttcccgctggagcgccatgtgcgcgacctgcgcgtgcaccagatcctggaaggcaccaacgaagtgatgcggatgatagtcggccgcaagctgctgcaagacggcgcgctggaaacgctgcgctaagcccaatatcagccagcgcgagggcaggcgccgcctgctctcgccaagaataaatactcgaggaatctccgtgcaaaactacgcccacctgaacgtggaaaaacgcggccacacagccgtagtcaccatcgacaacccgccggccaacacctggaaccgcgccagcctcaccgcgctgaaacagctgattgccgacctcaacgccgaccgcgacatctacgcgctggtgatcaccggccagggcgagaagttcttctccgccggcgccgacctgaatatgttcgccgacggcgacaagaaaatcgccaccgagatgaccatgctgttcggcgaggctttcgaggcgctgtcggctttccgcggcgtcagcatcgccgccgtcaatggctacgcgatgggcggcggcctggagtgcgcgctggcctgcgacatccgcatcgccgaagagcaggcgcagatggcgctgccggaagccggcgtcggcctcttgccctgcgccggcggcacccagaacctggcgtggctggtgggcgaaggctgggccaaacggatgattctgtgcggcgagcgcgtcaacgccgccaccgccgagcgcatcggcttggtggaacaggtggtggccaagggcgaggcgctggaaaccgcgctcaagctggccgagggcgtggccaagcagtcgccgtcgtcggtcggcgtgtgcaaacagctggtgcaggccgcccgtctgcagccccccgcctggaacctgatcaaggaacgcgaagccttcatcaagctgttcgacacccacgaccagggcgaaggcacccgcgccttcctggaaaagcgcgcgccgaactggaagaacgcctagcccccgcccactactcgaacaaggagccgccatgcaagacgtggtgctgtttgacgaactgactaccggcgacggccatcgcatcgccatcgccaccctgaatgccgagaaatcgctgaacgcgctgacgctggacatgatccggctgctggacgcccgcctcaccatctgggagcgcgacgcaggcatcgtcgccgtggtgctgcgcggcgccggcgaacgcgccttctgcgccggcggcgacgtgcgcagcctgcgcgacaagctgatcagcgaaccgcactatcccaatccgcacgcggtggccttcttcaccgaagaatacacgctggactaccgcatccatcgctacaggaaacccttgattgtatggggcggcggcatcgtgatgggcggcggcctgggcctgatggccggcgccggccaccgcgtggtcacgccggccacccgcatcgccatgccggaaatcaccatcggcctgtacccggatgtcggcggcagctggttcctgcaacggatgccggcgcacctgggcctgttcctggcgctgaccggcgcgccgctgaacgcgcacgacgcgctgatcgccaacctggccgaccatgtgctggcagcggacgcctatccggcgctgctggaggccttgcaagcggcaaactggggcgacgacgcccatgctcgcccggccttggtcagcgcgctgctgaaccagttggagggccagctgggcgacgcgctgccggcgtccaatgtcgagcgcaatctgctggcggtgcaccggctgatgaacaagggcgacctggccgccgtcagcgccgcgctgagcgaaacggcgttcgaagacccatggctcgctgacgccgccaagaacttccgccacggctgccccacttccgccgccgtcagctgggaaatcctcaaccgctccaaacacatgtcgctggccgaggcgctgcggatggaactggcgctgtcggtcaacttctgcgcccgctccgacttcccggaaggcgtgcgcgcgctgctggtggacaaggaccgcaatccgcattggagccggcagttggccgacatcgaccaggcctgggtggacggccacttcgattcgccgtggcgcgaagccgaccacccgttggctggcttgaaataacaacgacaagcataaagaggagaaccgcatggaaaacatcgccttcatcggcctgggcaatatgggcgggccgatggccgtcaatctgctgaacaagggcttcaaagtcagcgctttcgatctgtcggccgacgcgctggcccgcgtggccgccgccggcggccgggccgcgtccagcgccgccgacgcggcggagggcgctagcgtggtgatttccatgctgccggccggcaagcacgtggctgggctgtaccagagcgacgacggcctgttcgccaagctgcccaagggcgcgctggtcatcgattgcagcaccatagatgccggcaccgcgcgcaaggtggccgaggaagcggccgcccgcggactctcgatgctggacgcgccggtatccggcggcaccgccggcgcggcggccggcaccctcaccttcatcgtcggcggcgcggcggacgatctggaacgcgcccgcccgatgctggaagcgatgggcaagaacatcttccacgccggcggccccggcgccggccaaaccgccaagatctgcaacaatatgctgctgggcatcctgatggccggcaccgccgaagcgctggccctgggcgtgaagaacggcctggacccgaaagtgctgtcggagatcatcagcaaaagctccggccgcaattgggccaccgagctgtacaacccctggcccggcgtgatggaaaatgcgccggccagccgcaactacaccggcggcttcatgtcagaactgatgttgaaggacctgggcctggccgaagagaccgcgctgcaaagccactccgccaatccgctgggcgcgctggcgcgcaatctgtatgaagagcacgtgcacctgggcaacggcaagctggacttctccagcatcgtcaagcacttccaccggctggacggataacaggtctagatatctgccacataaaatatgacgtgtgatagattgaatcccgcgtctgcggacgggaggcccagggcggcctcccgttttgcatgaagacgcgataaagtatcaacaaaagcaaagtctgcaaggatgaacatgcctcaactgcacgccctgaagagcatcgccgccgccacgctgctggcctgcgccctgcccgccgccgcaggttatcagcaacctccggccaatatcctcaaagcgatgcgcgcgccatcgctgcccggccccagcctcagcccggccaaagacaaaatgctgctggtcgcctggcaggaatacccatccatcgaacgcgtggccgctccgtatctgaaactggccggcacccgcgtggaaacagccaaccgcagcaaacacgacacccctggcggctacggcatcgccccctgcgccgaaagcttcaaactggtgacgattcccggcggcaaggaaaccgccatcgccctgccggccggcgcctgcccggacgcgccgatctggtcggccgacggcaagcgcttcgccttcgccaacgccacccgcgacgcggtcgaggtatgggtgggcgacgccgccagcggcaagatccgcaagattcccggcatccgcctcaacccgatgctgaacgacgaactgcaatggatgccggaccagaaaaccctgctggtcaaggccgtgccggccaaactgggcgccgcgcccgccaaacaggcggcgccggatggcccgaacgtgcaggaagccgatggcgaaaccggtcaaagcagcacctatgaaacccgcgacaccctgtccagcccgcacgacgaggcgctgttcgactactacggcgcctcgcagctgacgctggtggacgccgccagcggcaaaaccgccttgctgggcaagccggccatctacgatgccgtcgaccccgcgccggacggcaagcatgtgctgatcagccgcatcgccaagccctactcctacgtcaccacctacgagcgcttcccgcatgaggtggaggtgtgggacatcaccagccccgcgcgcatcgccacccatcacatcgcctcgcagccgctggccgaccgcgtgccggtgcacggcgagccgctgggcccgcgcgacttcttctggcgcgccaccgacccggccacgctgctgtgggcggaagcgctggacggcggcgactggcagaacactgcgccggcgcgcgacaaggtcatgcagctgaaagcgccgttcaccgccaaaccggcggaagtgctgcgcaccacgcaacgcttcgccggcataggctggaccgaacgcgccgataccgcgctggtgagcgaagtcgacctcaacaagcactggcgccagacccgcgtcgtcaacctggacgatcccaagcagccggccaagctgctgtgggacatggcttacgacaaccgctacgccgatccgggcagcccggtgcaccgcacgctggccaacggcgagcgggtgatccagctggacggcgacgccatctacctggccggcgccggcgcttcgccgcagggcaaccgccccttcctcgacaaattgaacctgaaaaccggcgtcagccagcgcctgttccgcagcgacaagtccgcattcgagcgcttcatcgcgctgtccggcaaggacgccggcagcttcctcacctggcgccagacgccgaccgaggcgcccaacgccttcctgcgcaagctgggcgcgccggtcagcgccgacaagggcgaagccgcgttcgcatcgagcgaaaccgctgtcacccatatcgtcgatccgacgccggaactgcgccagatcaagaagcggctggtgaaatacaagcgcgccgatggcctggacctgtcgttcacgctgtacacgccgccgggctacaaggaaggcacccgcctccccgccattctcaacgcctatccgctggattacgccgacgcagccagcgccggccaggtcagcggctcgcagcagaccttcacccgcctctaccagtacaaatacctgctgctggccggctacgccatcatcgaccaggcctcgttcccggtggtgggcgacccgaaagccgcctacgacacgtatctcgatcagttgaagatggacgcggaagctgcggtgggcgaagcggtgaaactgggcgtagtggacccggaccgcgtcgccgtcaccggccacagccacggcgcgctgatgacagccaacctgctggcgcacaccgatctgttccgcgccggcgcggccaccagcggctcttacaacaagacgctgacgccgttcggcttccagagcgagcgccgctcggtatgggaggcgccggaggtctaccgcaaggtgtccaccttcttctacgccgacaagctgaaaacgccgatcctgatcgtgcacggcagcgatgacgccaaccccggcaccacgccgctgcaggccagcaagttctacgaggcgatccgcggcaacggcggcaccgcccgcctggtgatgctgccgcacgagccgcattggtacgcggcgcgcgaatcgaacgagcaactggtgtacgagatgctgagctggttcgacaagtacgtgaagaacgcgccgccgcgcgcggccaaaaccgcgcaaagccagccggcgccggcccagccgtaagcgcgccggtccagcaaagcaaacgccccgcaatgcggggcgttttcgcatccggggtcaagccggcacgttgatgcggcgccggacatgctgcagatgggcgatgatggtgaagctcatgatcaccagcagcgaccaagcgctccacttgccgacgtggacgatcgaccaggcgcccagctgatgagggtaacgccacacgccgtagaaggtgccgatgttttccgccagccagatgaaaaagccgatcagcacgaaagccagcagcagcggcatgcggcgctcccgatccagcggctggaaaatcacggtggcgcgcgcgtataaacccaaggcgcaggcggcgatataccagcgatagtcgccgatatagtggtgggagaagaaattggcgtagatcagcgccgccaccatcgccgccatccagtacggggggtggtgctccacccgcaatttcaacaagcgccaagcctggatgatgtagctgccgaccgccgcgtacatgaaaccggaaaacagcggcacgccgaacaacttgctgtaggctaaatccggataactccaggactgaatgccgcttgaggtcttgaacgcctccagcgcgaagcccagcagatggaacaaggtgatcgccttcagttcgtccaggctctccagtccggtccacaacatccacccctggatcgccagcgcgatcaacaacagcaggtcataacgcggcacgcccaaccagccgccgcgcggcgtcaggaatatcgcggcgaaaaacaggccggcgaataggcaggcccgcatttccttcagtccgaaaaaccagaactcgcggaccgacagccgccaaccacccaatccgccgccgccgcgcgacaacaaatacgcgtccaagtctcgcaaatgacgccgccccgccgcttctacccgcattcactccgcctttcacgccggggcagcggccaaccagctacccgtctcaaagagaaacggccattttcaagactccctccggcgtttgcaatactcgcctcagccccgccgcgccgccttgttgcgcaccttccactcccgccgctgctgctggcgctgcagcgcggtctgctcgtgacgctccagctcgcgcctcagcttgtggtagttgcgcagccggtctcccgctacgccctccctcaccgcgcagcctggctcctcgcggtgagtgcaatcgcggaactggcagcggccggccaattcctcgatatccgcgaagctgccggccaaagcgccggcgtcgggcggcgcttgcagggtgcgcacgccaggcgtgtcgatgatgcaagcgccgtccgggcatttcagcagcgtgcgcgccgtggtggtatggcggccgcggctgtcatccgccctcacgccgcccaccgcctgcgtctcctcgcccaatagcgtattgctgagcgtggacttgccggcgccggacgagcccagcagcaccagcgtctggcccatgcccagccacggccgcaaagcgtcgcggcaggccggatcggtgccgttcaacaacaggatgggcggcaacggccgcagccgctgctccagctcggccagcctggcttcggcgtccgggcacaagtccgccttgctcaataccaccaccggcgccacgcccgccgccgcggccagccccaggtagcgctccagccgacgcgggttgtaatcgccgtccagccccatcaccagcaaggcggtatcgacattgctggcgtaggcctggcgcgcgccttcgtcgttgacgcggaccagctggttgaacggttcaaggcgctcaagcaagcgccagggctcatgctcccgcggctggcacagcgtccaatcgcccaccgccaactcggcgtgaacgccgggcaaggcatgcgcctgccgttcctcttcgccatcgtgcacccatgcgcagtcgcgctgcacccggcatacgcgcaccagttgccagtcgtcatcgccggccatggccagcgcttgttgcagcaatgccggcgtcaggccgatggcggccagacgcggaaaatcgaaattcagcatgaaaactccagtgaacgctctcccgccgatgccgcatgcgcagcccgcggctcagtcaagcattcgaaaatggatagggaatcgcgcctgatggacaggcagagtcatcgcgcggggtcgatgtttagggaaatgccggggaacggccgccgagcggcgccgcttaaaacagagaaactatcgaaaaatgaaacgaccggggcgacggttcagccggcatgcccttgaaattgaatatcgcggctcattggaatctccttcacgctgtcggatgggaaagcgcattatgccaatgaggcatgccattcgcaagccaaccctcgccatccggctacggcagcagcgtgcgcgccggctgcgaccagaatgccgcatccagcgcatagtcccgctcgcgctccggctcgccgggattagccagcaccaggtgcagcctgggcgcgcccgccgccggcaacgccagctgccatccggccagcgtgtgttcgcggccagcgcgccacagactgttgtccgggccgtcatggcggtcccggctcagctgttcgaattcagccagcgtgtgcgccggattctgatccagcaatagtcgaacgcgcgccaaccgcgcctggctgctgggaccgatcttctgttccccgtccagcaaggacgtgtcgaaataatgattggtgtgcgccagggtgccgttttgctgccgggtgacgcggtaacggccatgctggccgatttccacctgcatcaggccgccggcgtcggccagcaacaggaacaccggccgaacctgggagaacagctgatcggcggcggcggccacttcgtccagcgagccgtaatcgcgcagcagccgcgtcagaacgccatggcgcgagctatcctgccgcaacgcccgcggcaggctgctggcctcggccccgaccaccgccagccccttctcgttgaccccggccttgattcccggctcgctgcccgtatcggcgtacaagcccaggtaggcatggccatgcgccggatgatgcagccgcagcgactggacatggtccggccgccagtcgcggttcttggccagcagcgtcccatccgcgctggccgcgcccgccgctccccacagggtgcaggctgcagccggcccgccaagccacgccatccacaagaccaacgccaaccgcgccatccgcatgctccgctcccaaggccccccgtggcctgtcgcaggcgcaaacgggcatttatggccaacataaacaatacaaattctacccaacgacgacaatccccattgcgttagcataagtgtatgtcagactgactgctcggcttccttcaacctgcgacgcgccatgcgcttacttacgcgatggcccatccgcccgaaactgcgcggccaaagcccaattgctccaatgcgacgattattgaacgaattccttcccgccggccgcataaaccgcaccggttttctatggcggcacgccatcgttctgccgccggccttgtggctggcccgccaggcggatagcctggcctgctccgccggtacgctggcctcggcgctgctgctgttattcctgatcagcgcctggacaagaaggctgcacgatctggaccgctccggctggcgcttgctgttggccgcgctgcccctgttcggccccatcatcctgatcgcaacctgcctgcgtcccgggcgcgccatcgccaaccgctacggttcggccccgggattgcgcgaagactacaccaccgttcaagcctcatgagccatcaccacatcgtcaacgacgtgacgcgcctgaatcccgtgcgcgtcatggccatcatcgccccggagtccgtcgcggacgtgcagcaggcgctgcgccgcaccaatggtccggtttccatcggcggcggccgctacagcatgggcgggcaaagcgccagcccgggcagcctgcacttcgacatgcgctcgctgaaccgcatcctgtcgttctcgccgcacgagcagacgatacgggtgcaggccggcgtccgctggtgcgacatccagcgcttcatcgacccgcatgatctggcggtcaagaccatgcaaacctacgccaacttcaccgtgggcggctcggtcagcgtcaactgccatggccgttacgtgggtctggggccgctggtgctctccgtgctctcgctgctgatcgtgctgcgcgacggcgaaacggtacgcgccagccgcgacgagaacgcggagctgttcttcggcgccataggcagctatggcgccctgggcgtgatcgtggaaatcgagctcagcctgaccgcgaacaagcgggtgaagcgccagcacaaagtgatgccgctggccgactactggacttatttcaagaatgcggtgcgcgacaatcctcaagccgtctttcacaatgccgacctctacgcgccgcgctacggcacggttcgggcgaccagctggatggaaaccgacgagccggcgaccacgcccgaccggctgtccccgctgaagaagtcctacccgctgcaccagtacgtgctatgggccatctcggaaacgcccttcggcaaggaaaggcgcgaaaagctgctggacccactgttgtactggcggaaaaaagtgcattggcggaatttcgaggccggctacgatgtggccgagctggagccgccatcccgccagcaccgcacctatgtgctgcaggagtatttcgtgcccgtcgcgcagcttgaggctttcgtggcgcgcatgggggagattttgcgccgccatcgggtcaatgcgctgaacatctccatccggcatgcgatgccggaccctgacacattgctgggctgggcgccggtggagacgttcgccttcgtgctgtattacaagcagcgcacgcgggaaaacgccaggagccgggtcgccgtctggacccgcgagctgatcgacgccgtgaccgcggtcggcggcaagtactatctgccctaccagccgcatgccacccacgcgcaattccaccgcgcctatccgcgtgccgagcagttgttcgagctgaaaaagcgcctggatccggacttccgcttcaccaatgccttatgggacaagtactaccaagcctggctcgcgcgcggacaagccgcgccccttcccgccccggcgtccgaattccatcaggtgtttgacgatgtcggcctttccgacgcgttctaccgcttcctgcaaacggtgttccgcatcgccccggaggacagactgcaccagctgatccgcgaggcctgccggcattgcggcgatgaagaaagcgtttaccgctacctccagcaacgcttcgccggcattcgccccgcgctggccgatctgcgctatgccgtgccgtcgctgttgcggcaaaagcgggaaatgacccggcagaccctggccttgctgaatggccggcgccgcttcgacggctacgccgaaatcggctccaaagggcgttattaccggggcttggccgcggcgctggacatccgcggaccgcgcttcttcatcgatgagcatgcgcaaaccttctcgccggccgacatcctggaacgcggccaattcaagcgcctgccccggcacctgccgctgaacgactacgcgcccatctgcccaaacgccatccccgacgccagtctggacctgctggtctgctatgtcggcttgcatcacatgacgccggacaccctgacggcctttctggcctctgccgcgcgcgcgttgcgccccgacgggctgttcatcgtgcgcgaccatgatgtctgcgacgacagcatgcgggcgctggtttcgctggcgcacacggttttcaacgccagcctgggcgaaagctgggaaaccaaccaacgcgagctgcggtatttcgcgccggtcgcgcactggtcgcgctgcctgcggacagcgggcttcgaggacagcggccagcggctgctgcaagccaacgacccgacggccaataccctgctgtgctttgtccgcctcccggcggcggacgccgcggcaaggagcgcatcgtgaggccgccgcgccgctggctggcgcgcgccgcgttgacgctcgtccttgccctgcccaccgcaggaagcgccgccgccccggcggaatatcgccgcccgccggagcagacctacctcacctttcccgaatggtatctggtgcacagcccggccgaatatgccggctacctgcaaagcggcgcgcctcccagcggctttcccttattcgcccacatcggccagttctggcaaggctatgccgccatgacccgcgaaacggaacgctatccgttcaacggcggctaccatctgatggtgatggtcatcggcgccagcaccaccatcgaatacggcatcaaggggctttacgaacaaaccgtgggccggctggcggaagccagccgcggaaccggcccgatgctgcccgaagagcgcttcgccgcgcgctatgcccgcgactacgtcgacttcatccgcgttgacccctggtaccagttcgatttcttttcccggctgcgccaattgtggcaaggttccctgccgctggacggaaaccatccgctccgccgctgggagcggcgttacctgctgagcagcgagctgctggccaaagggattacggccagttgatcaagttggcgacccgcacggtttacgatgaggccaaacctcaaaccgccgtcgtcctgcgccacgcgccgccggcctcagccgatcgccgcaactatatcccgcaagccgctcaagatggcctcacgcccgccctgctgcctcgctatcaagccttccaagactatagcctgtggctagcgcgaaacggcgcggacttccaggaaatcgccggcaaccgcggcgaaatcctgatcagcctgctggcgcctgacgcctggcgcgcgcctggcgacgggcggctattgctggagcagccgatattgacccagccgggccgcaagcgcgcgctggtcgccgtgccggtaggacaattggccggcctgctgcgcctgagcgccgcgcaagccggagtcgacctggagcatgtgtacgattattgaggccagggccaggcgtcaggacgggaatgcgtactccagcatctcgtcgccgtatttgtcgactcgtccggtggcggtccagcccaggcggcggtaaaaaccgtgggagcgcaccgccggatcgctgctgcagccaaggaacagccgctggtggccagcctcgcgcaggctggccatcacctgcgacagcagcgtcctgcccgcgcccatgccttcgtaatcgggcagcagggccagcaccaccacttcgccgcttgccgcgtcgccaaagcagtagccgatgatgcggccgccagcctcggccaccacgctgggcagctcgccgacgcgcacgctttgcgcccagctcgcgcgcgtgatgcccagttcgttcagcctggcttccgaaatggcgttttcgcgggtctggccgcggatgacgacgcaggccggcacgtcgtccggacgcgcggcgcgataaaggatgggactcatgtattttttctctttgaaagaacgatgaatgctggggtcggacccggccacgttgaagaaggttcgccataacatacccgaaccgcggcgaatatcgaccccgccagtcgcaaaaacaagccgcgagatccgtttccagttcccgcggctgttttaggccagaggccgccagcatgcctgcgcccacattcgaaatgattttttcccgcgttagctctccgcgcccggatctttggcgcgcacttcgtagccccgcgcctggatcgctttcacccactcgccgatggcgatttccaccagtgccggctggccggcgaagccgaactcgatatgcatctctgggatcgcctcattgccgaaactgggcaggctggacagtttcaacgccggatagcgggcgctgaattcctgcatcaggccgatcagatcgccctcgcgggcctggatcgcgatgcaggatttttcgatgtcgggctggtcgttgaacaagtggcggcagtgcgtgtccagcacccactccgccatcggccaggccatgctggggaagcccggcacaaaatggacgctgccgtgggaaaagccggcgatctggttgaccgggttgggaatgatggccgcgccttgagggaaatgacccatctggatgcggtgcggataggcgtcggcgccgaagcgcgcctcgatcagcgccttggcttccgggtgcggctccagcggcaggcccagcgcgcgggcggcacagacgcgggtatggtcgtccggcgtggcgccgatgccgccgaagctgaacaccaggtcgccgctggcgaaagcgcggcgcaaggcggcttcgatgcgggcgggatcgtcgcccagatattccgcccaggccagcttgatgccgcgcgcggccaggatgcggatcaaggcctgcatatgcttgtcctggcgtttgccggacaatagctcgtcgccgataatcagcgcgccgacttgcatgcttttactcctgtttggcacaaccagagcgagttaactcgccgtgattgttgatgcgtggctcagtactcccggtcgttttccggaagtcacggatatcaatgctgcagaactactgcaatccatccttggtttcctgagcggaaccaaccaggcacccgctcgtattcatccatgagatcacaaaatcagcgtcagtttcactcgctggcgcagcttgatcaaatgccgagagacattcctcgtgagatgcccgatccgccttgctaacggaaatcatgactccgacgcttctcccagcgtctgctgattcactgtggcggcgaagagctgagccaaggcttgtttccaatcatttttcccattcagaatagcggctattcacggtttaacgccgccctcttccagcatgcgccggcacacggcgtagcaatcgtcgatatggctgttgccgatgtatttcatcgcggcgaagcctatcgccgcattggccgcccagcccagcaccggcaccagcttcaacgcctgcttgccggcccagcgcccgctgatgcggcgaaccatggcggtcagcaacgcgcggctgacttccaggcccaacagcgcgctgccggcgcggcggatcagctgatacagcagctgcttgcgcgccgcgtcgtagccggcgatctgcgccggcgccacgccgaagcgctgattgatcgccggaatcagccgcagcaggatggccacgtcggcggcgacatccatcccaggcgcgggcaaagccgaggcaccagccgatagcgccgcccgcccgttcaccagcgcccggcattcgtcgcggatggcgtccagttcatccaggctggccggcagcatttcagtgcgcctcgcccacttgcggaccggccaacgcgtccttcggcatcgccagttgcttgaccaccgcctgcgcggcggcgaaatccgtcgtggcgatcacgcgccgccaatcttcggcgccgctcttggccgccatccgctccagccgctccgccaacttgggctgcggcggcggaaccagggcggccagcatcgtatccgcctcttctggctgattgcagaccagcaccatgtcgcagccggcggccagcgccgcgtcggcgcgctgcacgtaagtccccgcgccggccgcgccggccatgtccagcgcgtcggagaagatcacgccgtcaaagcctatcttgtcgcgcaggatgtcgctcagccacactttggagaagcccgccggttggccatccaccgccggatacagcacgtgggccggcatcaccgcgcccatgccggcatcagccaggcgggcgaacggcaccaggtcgtcgcgttcgatctcggccaggctgcgctcgtcccgcggcatcaggtggtggctgtcgccttccacatagccgtggccgggatagtgcttgccgcagctcatcatgccgccgcggcccagcccctgctgcagcgcctcggccagcgccgccaccgcttgcggatcgcggtggaaggaacggttgccgatcaccgcgcagcgctcccagttcaggtccagcaccggggtgaaagacagatcgatgccgcaggcggacagctcggccgccagcacgtagccgacggtttccgcctgcttcagcgcctgttcgcggtcttcatcccaggcttcgcccagcacattcatcggcggcagccgggtgaagccgtccaggaagcgctgcacgcggccgccttcgtggtcgacggcgatcaacaggtgcgggctgcgcaaggcgcggatctcggtggtcagcgcgcgcagctgttcgatgttctggaaattccggcggaacaggatcaacccccccaccagcggatgggacagccgggcgcgttcctgttcggtcagcgcgaagccggcgacgtccaccatcaccgggccgcgcggcagattcaaagtcgtttgggtcatggttcatcctcgaccataggggcaggcatcgccgccacggatattgcaaagacaagggcggcgggccatccgttcccgcggctgccgcgtgccggcggcccccgccctacgattccagcacgacgaaggccagcgcgtggccgcgttcgtcgctgatggacagatgcatgcgcgcgacgccgcgcgacgcggcgaaggccgccagctcgtccgacaaaatcaacaagggtttgcccagcgcgtcatggccgacgcctatcgccgtcagcagtgccggcgccaccacaccggtgcccagcgccttggcgaaggcctccttggcggcgaaacgcttggagaggaaccgcgccggttcggcatgcgcggcgaattcaacctgttccgccgccgtcaacagcctccgtcccgccttggcgccccagcgctggcaccacgcctccatcctggcgatctccaccagatcggtgccgatgccgtaaatcatgcccgcgcctcgctaccgcggcgcagccacagccaacgcgccgtccacagcgccaggcacggcagccagacgtaggcgaattcggtatacaccacgcgccagcccttggcgctgaaccagcgtttcaggcctagcggcgagccttcgatcaagcgccagtcgctcaggtagcggtggccggaccaaggcatgaacaaggccggaccgaagctggcgtcgcaaatcatgtccaacgccgcgtgcgaagccgccgccaggaatagcagcgtggccgcagccgccgcgctcagccccatccgccgccagagcgggcggcacagccaggtcagcacgccggcgatcaaggccgcggccgccagcgaatgggaaaagccgcggtgcccccacggactctcgtagggaatgcccagcttgaaagtcaccacgtccaggtccggcagcatggcggccgcgccgcacagcgccagccagggcagcatgcccggcgtggagaccggcttgcggctggccaggccggccagcgtggcgccggccaacgcgtgggtgaagacggttggcatcagcgggcgctgtccatcagcgccttcatctcgcgcaccgcctgcgggaaaccgacgaacagcgcgtgggcgacgatggcgtggccgatgttcagttccgcgatctgcgggatggcggcgatgggcttgacgttgtggtagttgaggccgtggccggcgttgaccaccatgccgaggctcgcgccgaacgcggcggcctcgcggatgcgggccagctcggcctcgcgttccttggcgtgcggcgcgtcggcgtaggcgccggtgtgcagctcgatcacgcgcgcgccggcgtcgtgggccttctggatctgcgcgcggtccgggtcgatgaagatggagacgcggatgccggcttcggccagcttgccggtgtaatgcttgacgtcgtcgaagtggccccgcacgtccaggccgccttcggtggtgacctcctcgcgcttttccggcaccaggcagacgtcttccggcgccacttccagcgcatgcgccagcatttccgccgtcatcgccatttccaggttcatccgggttttcagcaccggacgcatcgccttcacgtcggcgtcctggatatggcggcggtcttcgcgcagatgcagcgtgatcaggtcggcgccgctggattcggccaccagcgcggcctccaccggactagggtagcgggtgccgcgcgcctggcgcagggtggcgacgtgatcgatgtttacgcccaacaatatcatttgcttctcccttgtcttgacgccatcagtccgacagggactggatggcctgcaataattcgcgcgccgccagcggttcgtcgcccagcagggcgtccagccagacccggctgagctgccgcgcctggcggcgggtggcgtgttcggaatagtcgtcggcgtctatcgccagcagcgccgcgccggacagccgcgccgccttgccggccaactccagatgcggctgctcgtccagctccggcatggccgcgttgcggcacaggtagtggcgctcggcgtctatctcgtcgccgcggctgtcgcgcttcagcgacggcgcgtagcccagcacctggctcagccgcaactcatagcggcgcaataccggcgacagcgacggccgcgcggccaggtcgcgcaccgcggcgtcgtaaacggaaaaagcccgcggctcggggtcgtcccgcgccgtgagcttcatcatcaattcattcaggtaaaagccgcagaccagcggcaggccggacaagggccgcaccccgccgtcccagtcggcgccgtgcagcgtgcgcaattctcccttgccgaaccacgacagggtcagcggctggaacggcaacagcacgccgcgcaggtcggaacgcggccgccgcgcgccgcgcgccaccaggctgaaacggccgtggtcgcgagtcagcacttccagcagcaggctggtctcgcgataaggctgggtatgcagaatgtaagcgggctgcttgtccaccctgcccggctggctcatgcgctggattcccgcggatcgatccggctcaccaggaaggacagctccggcgccgcgtcatccgcgcccctgccctgccgcgccaattgctcggcgcgggcgcgccaagccgcgatggcctcgaccgaatcccaatacgtgacccggccttcgccgcccagatagcccggctgcgccgccgccagccgcagcacgcagcgggccggatcggagcgggccgcctccgccgccaggctgactgcccagcaggcctgcggcggccgcgttgtcatggaagctgccacggccgctcagttcaggccgaactcgcgcaggaagcggacatcgtcggcccagccggacttcaccttcacccacacctgcagaaataccttgccgtcgaacagcttttccatgtcgaggcgggcctcggtggaaatcttcttcagcttctcgccggccttgccgatgacgatgggcttctgatgctccttgtccaccagcaccgcgatatggatgcggcgcagcgcgccgtccatctcgaacatttccacttcgacgttcatctcgtacggcagctcttcgcccagatagcggaacagcttttcgcggacgatctcggcggcgaggaagcgctcgttcttgtcggtgaccatgtcctccggatacaagggcatggattcgggcaggtgcgggcgcacctggtccagcagctcggccaggcgctggccgtgcttggcgctgaccacttcgacgccggcgaactcgaactcggccgtcacctcattgatgaaggcctgcagcgtcagcttgtccttggccttgtccagcttgttcaccaccaggatcaccggggtcttcttcggcagcagcgccatcacttccttgtcggcggcggtgaagcgcatcgcctccagcaggaacagcacgcagtcgacgctgccgagcgaatccttgacgctcttattcagcgcctcgttcagcgcgcccttgtggtaggtctggaagcccggggtgtcgacaaacacgaactgcgccgcgtcttcggtatggatgccggtgacgcggtggcgcgtggtttgcgactttttcgaggtgatgctgatcttctggccgatcaggtggttcatcagcgtcgatttgcccacgttggggcggccgacgatggcgacaaagccgcagtggaaaggggtatcggtcatgattttttcttgctcgcagcgaatttctgttccagcagggtcagggccgcttcggccgcctgctgttcggcggcgcggcggctgccgccgtcgccggtggatatcagggccagctcgcccaggtcgcactccaccttgaaccattgctcatgcgcctcgccgctctgcgacaggatgcggtacttcggcaactgcagcttgcgcgcttgcagcgcttcctgcaagcgggtcttggcgtccttggcctggcgggtggtgtctatggtcgacacccgctggtcgtacaggcggcgcaccacttgttcggcggcgccgaagtcggcgtcgaagctgacggcggcgaaagtcgcctccagcgcgtcggcgaggatggacgggcggttgaagccgccgcttttcagctcgccctcgcccaggtacaggtagtcgcccagtttcagctcatgggcgatttcggccagggtgttttgattgaccaggttggcgcgcagccgggacagttcgccttcggtcagttgcggaaactggtcgaacagcatccgcgccacggtgtaattgagaatgctgtcgccgacgaactcgaagcgctcgttgttggcgctgctgtagctgcggtgcgtcagggcctggcgcagcaattccggtttctggaaagcataatccagcgcctgggacaggcgccggaaacggttgtcgatttgggtcacgatgttgttattgggcaggcggttgacctgcctgggtgtcgaaattgaaaagcaggctgacgttgccgaacagcggcacctcgcggtgatactgggcacgcagatagttgccgttgccgccggcgaccacgatcaggttgtcgcccttgatcgagacgattccggccacgctggccttggcgtcgaactcctggcgcagcgtatgctcgccgacattggtctcggtggacagcgcgctcagcgacgacttgacgtcgccgtattcggaataaaccggcaccaccttgaacaccagcaacagcgcgaagccgacgagggccagaaccaacaaaaccgcaattaccgacaaacctttctgctgcctcatgcgcctctcctggtcatggccgcccgcgcggccttgagttattttacctgggtgccgatacgcgacagattgccgaagttcatccagatcatgaaggccttgcccaccatcagcttgtcgtcgacgaagccccagtagcggccgtcggagctgttgtcgcggttgtcgcccatcatgaagtagtggccctgcggcaccttgcagacgaagccgtcctcgtcatagcggcagttgtcgcggtagtcgaaatctcgcacctggctaagcgccaccaccggcgtgccgacattgttcaatacatggtaggtcttgccggcctgactttcgcggtattgattggccgtgatggtctgcaggcccaagtccttttccaggtagtcatagctgccgtccggcacatcctgcagcggcttgccgttgatggtgagccgcttgttgcggtattccaccgtgtcgcccggcaggccgatcacgcgcttgatgtagttgatcttcggttccggcgggtagttgaacaccaccacgtcgccgtgctccaccttgttcaccgggatcagcacattgttcagcaccggcacgcggatgccgtaagtgaacttgttcaccaggatgaaatcgccgaccaccaggcccggacgcatcgagctggacggaatctggaacggctccaccaggaaggagcgcagcacgaacaccaccaggatcaccgggaagaagccgcgcgagtaatcgacgaaatgtcccggctgggcgccgctggcggcgcgcttcttcgccagcagccacttgtccagggcccagaccacgccggtgatcagcacgaacaccagcatgaccgcggtaaagctcatatagctggacagcaggccgaagccgccgatcaccagggccagatagccccactgcacggactgcggccagtccttgtcgccgtcctgcttcttgccgcccagcgccaccaggatggcgccgaccacggccgccgccacgaacccccagaacaagtttgcacccacttatttgtcccctacttgaagaatcgccaggaaagcctcttgcgggatttccacgttgccgacctgcttcatccgcttcttgccggccttttgtttttccagcagctttttcttacgggtgatgtcgccgccgtagcacttggccaacacgttcttgcgcagcgccttcaccgtttcgcgggcgatgatgtggccgccgatggccgcctgcaccgcgatgtcgaacatctggcgcgggatcaattcgcgcatcttggacaccagctcgcggccgcggtacacgctggaagcgcggtgcacaatcaggctcaaggcatccaccttctcgccgttgaccagcacgtccagcttgaccaggtcggcgctctggaattccttgaactcgtagtcgagcgaggcgtagcctcggctggtggacttgagcttgtcgaagaagtccatcaccacttcgttcatcggcaggtcgtaggtcagcatcacctggcggcccatgtactgcatattgcgctgcgagccgcgcttctggttgcacagcgtcatcactgcgccgacatagtcctgcggcaccagaatggtggaggtgatgatgggttcgcgcaaatcttcatacttgccggaatccggcatccgcgacgggttggacaccacttccaccgtgccgtccttcatcaccacttcgtagttcaccgtcggcgcggtggtgatcaggtccatgtcgaactcgcgctccagccgctcctggacgatctccaggtgcaggaggccgaggaagccgcaacggaagccgaaacccagcgcctgcgacacttccggttcgtacttcagcgaggcgtcgttcagctgcagcttttccagcgcgtcgcgcagcgcttcgtaatcgtggctttccaccgggtacaggccggcgaatacctgcgactgcacgtccttgaagcccggcagcgcctcggcggcctggttgttcaccagggtgatggtgtcgccgaccttggccgatttcaattccttgatgccggcgatgacgaagcccacttcgccggcgctcaggctgggtttctgcaccgatttcggcgtgaacacgcccacctgttcgcacaggtgctcggcgccggtggccatgaacttgatcttgtccttcggcttcagcgagccgtcgatcacccgcaccagcatcaccacgccgacgtagttgtcgaaccaggagtcgacgatcagcgccttcagcgggccgtccggattgccctgcggcggcgggatcttgctgaccacttcttccaggatgtcttcgatgccgatgccggacttggccgacgcgcgcaccgcgtccaccgcctcgatgccgatgatgtcttcgatttcctgcgagatgcgctccgggtcggccgccggcaggtcgatcttgttcagcaccggcaccacttccacgcccagctcgatggcggtgtagcagttggccacggtctgggcttccacgccttgcgacgcgtccaccaccagcagcgcgccttcgcaggcggacagcgagcgcgacacttcgtagctgaagtccacgtgccccggggtgtcgatcaggttgagattgtagatctggccgtcgcgcgccttgtaggtcagcgcggcggtctgcgccttgatcgtgatgccgcgctctttctcgatgtccatcgagtcgagcacctgggcgctcatttcgcgcagctccaggcccccgcagaattgaatgaagcggtcggccagggtggatttaccgtggtcgatatgggcaatgatcgaaaaatttcggatgttcttcatcggtttccagcaaaagataagggcacgcgcgcgtgcccgaggctgctgacggatggccgctccggaggcgcgccggcggagggccatgatcctggcgcgtccgacggctgccggaagccgatcagcaatcgggggcgcggccagcgcgcccccggtttaactcacactggcgcggattttagccgatttcgcccaagtgtgcagccaatctcgcagcatccagatgccaatggcagatttcggcctcgccatccatcagcaccggcaccaattcgttgaaacgggcctccagcgccgggtcggcatccacatccagcacttccagctcgaagccgtagcgttgccgccacggcgcgagctcggccagcatctggtggcacaggctgcagtactcgcgaaaatacaatgtcagcttcacttggcctcgcctatcgtcaaaggcacgaactgtaccatgccctggcgcatcacctgcaaggccaccgtgccgccgttcttcgcctgctccaaggccttcttcagttgggcgaagctttgcagcggatcgctgccgatgccgacgatgacgtcgcccggctggatgccggcgcgcagcgccacgccgttggcctggcgcaccaagaggccatacgcaatgccggcgcgctgcagctgggcggggctcagctcctgcaggcgcaggccgatctgggccagactctgctcgttttccgaacccggcttgcggtattcgcgctgcgccacccgcgcgtcttctgccttcagctcttccggcaccaccttgatgctcagcggcgcgcggttgcgccagatatccagtgcgatggccttgcccggcggcatgtcgctgatcagccgctgcagatcgccgccggaattcacatcctggccgttgaccttgacgatgatgtcgcccgccttcaggcccgccttctgcgccggacctttcgggtccagcgcgttcaccagcgcgccgctgggcttcgccagcccgaacgaagccgccaggtccttgctcaactcctggatcaccacgccgatgcggctgcgggtcaccttgcccttggccttcagctggtccgccacattcatcgcggtgtcgatcgggatggcgaaggagatgcccatgaagccgccggagcggctatagatctgcgagttgatgcccaccacctcgccgcgcatattgaacagcggtccgccggagttgccgggattcaccgccgcgtcggtctggatgaactgcaccgagctctcgtccggcagctggcggttcttgccggacacgatgccggaagtggcggtgttctcgaaaccgaaaggcgagccgatggccagcacccactcgcccactttcagcgtcttggggtcggcgcggcgcaccaccggcagattattggcgtcaatcttgatcaaggccacgtcggagcgggcgtcagagcctatcacccgcgcctggtattcgcgcttgtccgtcagcttgaccgtgatcttctccgcgcgcgccaccacgtgcgcattggtcagcacataaccgtcggaagagatgatgaagcccgagcccagcgaattctcttggcgttcctgctgacgcggcggcgcgaaacggcggaagaattcgaagaacggatcgccctccattccctccggcacatccgccgtcgcctccttcaccattgaggtggtgctgatattgaccaccgccttgccctcgctttcgacgataccgctgaaatccggcagctcagccgccatggcggcaggcagctgggcggcaaagaaagatgccgacagcattacggaaatgatcagttttttaaccgacatgtgcgctccatcttggatgtgttgtggattgagtttccggcgatagccggcagccagaatcaagcagaccgccgcccatcaggacgcccggtcatttcccatcaagcgcggcgccgacaggcgcggcacgcaaaactggccgctctcatcgcacccggcaatgaaaacggccagccgaaccacttcagccgaaggacgctcccggcgcagccgcgccgcttacgtccgcagccaccgaggcttcacgcatcgcaggctcaatcgttcttgccattgatgtgcaggcctttgagcagcgccatcatcgccgtctgcggcatatcgcccaccgcagtcagctgcatgtcgccctgatagctggtggccatattgatggcgccgtgcagattgcccacccgctccagcctggcgttctcaggcggcggcggctcgacgaataccgacagcatcaccaggccgtccgacagcaccagatggcgcaccggcttgccgccctgccccggcagcacgcgctgcaccgaacgcagcaagcggaaaccttgcggcagaccgctcacctcgttctgcgacaccgacggatcagcgcccaccggcgccttggccggccgcagcaggaacttctgcgccagccgcggcttgtacgccttcttgtccttcgcgccggccagctccacctcggtgaaagtgaattgctccaccgagtcgccgcgcggcgacagggtgatcactttcaagggcaggtaggtgctgggctcgatgcacatccgcatcgagtagcgctgcggatcgcgcggctgcaaatccagccactggcaatcgcgcttcgccacccggtccgaaccggtgcgcttgagcacgtaggaacgggtgatgtcttccagatcgtccggcagcaaggccgggaacagccgcatcgcgctgatcttgcacgccatcagcgcgcgcttgtcgggcgcgaaacaggtcagttcgccgccgtttcgcaccacctcgcgcgaggggccgtccaacgagacgcgcttctcgcgcaccccgtcgccttgcccctggcggacgatgcggaaggtttccaacatgccgttcatctgatgcagataggtgccatccagcgcctgctgccgtccggcattgccgacgttgcgcaacagctgcatgtcatcctcagcatgggccgcgcaggcggccccgaacatcaacacgccaatcagaggaacgacacgcatcagtggcgagctccgtttccgtaagacacgcgcatcacgctctggtcggcggtcacttcctggtgcgccagcacatagggatcgtcctgctccatcgccggctgggcgatctgcaccggcacgccccggtccgcgatggccgaagccggcgcggagcggtgggcgagctgctgccagcccaccaccgccgcgaagctgacgctggcggccaaggccaccgcgctggccgcccgggcgcggcgcggccgcatccagcggcgcggcgcgagcaccgtcggctcgtccaccatgcgctcggccaccttggcgcgcacattcagccccgccatgcgattggagcgcatcgcgtctccgatcaggtgatattggtcccaggccgcatccaggtccttgtcagcggcgatggcggaaagcgccttgtcggcttctgttccgtccagctcgccatccatcagcgcggatatcgtttctttcatacttaccaccttctgttcttggccgtatccagcagaggcctgagctcagcagcaattgcctcgcgcgcccggaaaatccgcgaacgcacggtgcctatcggacagtccatcaccctggcgatttcatcgtaggacaagccctccatttctctgagcgaaatggcggtgcgcagttcctccggcaaagcctccacggcggcgttgaccgtcgccagaatctccttgttcatcagctcggtttcgggcgtgttcatgtcgggaatctgcgacgccatgtcgaagctctcgccatcctcgtcctcgatctcgctgttcaccaccgggcgtcgcccgctggcgctgaggaaattcttggcagtattgatgccgatcctgtacagccatgtgtaaaacgcgctctcaccccggaaagacggcaaggcacgatacgctttgataaacgcttcctgcgtcacatcctcgatgtccgaaccgtcgcggataaaccgcgacaacagcctggcgagacgtcgctgatacttggcaacaagcagatcgaaagctcttttttcacctcgctgggcacgttccaccaactgttgatcgatgtcccgatcactcatgtcgttgttatgctccctggtttgcccactgttctatgtggtcgtgtacgtggactgtgatctagaccacaggctttgccttgagttcccactggcgaggacgtagcgaaacatatcactgtcgcggcaaaacttgaatatccgtttgacaactattgccagcattttgtggagcaattacactccaaccaagcacttgcttgaatgacaagcaactaccccatccctaccatcaggagcactccatgaacactcccgggcagcgtttccgccaggccgtggccgcagaaaaaccattgcaggtggtaggggcgatcaacgcctattccgcacgtttggccgaacactccggtttcaaggccctgtacttgtcgggcggcggcgtggccgcggcctcctgcggcattcccgacctcggcatcaccacgctggaagacgtgctgatcgacgtgcgccgcatcaccgacgcgagcgacctgccgctgctggtggacatcgacaccggctggggcggcgctttcaacatcgcccgcgcggtgcgcagcctggaaaaggccggcgccgccgccgtccatatcgaagaccaggtgcagcaaaaacgttgcggccaccgccccaacaaggccatcgtatcgcaggatgagatggtggaccgcatcaaggccgccaccgacgcccgccgcgacgacagcttcgtcatcatggcgcgcaccgacgcgctggcggtggaaggcctggacgccgccatcgaacgcgcagtcgcctgcgtggaagccggcgccgacatgattttcccggaagcgatgaccgacctcgccatgtaccagcagtttgccgaagcggtgaaagtgccggtactggccaatatcaccgaattcggctcgaccccgctttacaccaccgcggaattgggcgccaacggcgtcggcctggtgctgtatccactgtcggccttccgcgcgatgagccaggccgcgctcgccgtgtacggcgccatccgccgcgacggcacccagcgggcggtgctggacaccatgcagacccggatggacctgtacgaccacctgggctaccacgattacgaacaaaagctcgacgccctgttcgccgccggcaagcaataagcccggccccaggcgcaagcgacaacaacagcagaaaacggcagcagctttgcccattgtctacactaaggagaagtggcatgactgaagtggttctctccggcaaaccgaaaaaatccgtcgccctgtccggcgtcgccgccggcaacaccgcgctgtgcaccgtcggccgcagcggcaacgacctgcactaccgcggctacgacatcctcgatttggccgacaaggccgaattcgaggaagtggcctacctgctggtgcacggcaagctgccgaaccaggcggaactggccggctacaagaaaaagctgaaatcgctgcgcggcctgccggcttcggtaaaagcggtgctggaggcgctgccggccagcgcccacccgatggacgtgatgcgcagcggcgcgtccgccttgggttgcgcgctgccggagaaggacgaccacaacctggccggcgcgcgcgacatcgccgaccgcctgatggcctcattcggctccatcctgctctactggcaccactacagccacaacggcaagcgcatcgacgtcgaaaccgacgacgacagcataggcggccacttcctgcatctgctgcatggagtcaagccgccccaggaatgggtgcgggcgatgcacacctcgctgaacctgtacgccgagcacgaattcaacgcttccaccttcgccgcccgcgtcatcgccggcaccggctccgacatgcacagcgccatcaccggcgccatcggcgcgctgcgcggccccaagcacggcggcgccaacgaagtggcgttcgaaatccagcagcgctatgaaagcccggacgaagccgaggccgacatccgcgcccgcgtcgagcgcaaggaagtggtcatcggcttcggccacccggtctacaccgtgtccgacccgcgcaacgtggtgatcaaggaagtggcgcgcgaactgtcccggcaaaaccaggacatgaagatgttcgacatcgccgaacgtctggaaagcgtgatgtgggacgtcaagaaaatgttcccgaatctcgactggttctccgccgtcagctactacgcgatgggcgtgccgaccgcgatgttcaccccgctgttcgtgatcgcccgcaccagcggctggagcgcgcacgtgatcgagcaacgccaggacggcaaaatcatccgcccgtcggccaactacatcggcccggaagaccaggcctacatcccgctggaacagcgttgagccattgacgcaagcggcgcggccctccggccgcgccggccatttcggagcagtgaatgaagcaatcgttgttctggcagcgcctggattgtcccgggctggagcaagtccagctcgaaaccggctcaggcctgtctctttccgccagcggcagcctgctgcacgccgacagcggcgccagcctgcgctaccggatgcagctggaccatcacggccggctcagccacgcccacatcgacgtttccgcccccgaacccaggcaactgacgctgcagcacaccgaaagcggccgctggctgctcaacggccaggcccagccggcctgggacggctgccaggaactggacctgcaggcctgcggcctgaccaacgccttcccgatccgccgcctgaaactgggcgtcggcgacagcgtcgaactttccatgctgttcgtgcgcctgcccagcctggagccgacgcgctgcccgcagcgctacacccgcctgccggaccgcgacgggctggcctgctaccgctaccaatcgcccggcttcgccgccgacatcatcgtcgacgagcaaggcttcaccattcattacagcgactttctgcaacggctgcccgacagcggccgcgactgagcgaaagacagacatgaaccgccaataccgcaccgccctgcccggcaccgggctcgactatttcgacgcccgcgccgccgtggaggccatccagcccggcgcctgggacaagctgccctacaccggccgcatccacgccgaaaacctggtccgccgttgcgagccggcagccctgaccgaatgcctggaacaaatcgtctatcgcaagcgcgagcgcgatttcccctggttccccgcgcgcgtggtctgccacgacatcctgggccagaccgcgttggtggacctggccggcctgcgcgacgccatcgccgaccaaggcggcgacccggcccaggtcaacccggtggtgccggtgcaattgatcgtcgaccactcgctggcggtggagtgcggcggcttcgacccgcgagccttcgaaaaaaaccgcgcgatagaggacaggcgcaacgaggaccgcttccacttcatcgattggaccaagtccgccttcgacaatgtggacgtgatccccgccggcaacggcatcatgcaccagatcaacctggaaaagatgtcgccggtaattcacagcgacaagggcgtggcctatcccgacacctgcgtcggcaccgacagccacaccccgcatgtggacgcgctgggtgtgatcgccgtcggcgtgggcggcctggaggcggaaaacgtgatgctgggccgcgcctcgtggatgcggctgccggacatcgtcggcgtggagctggccggcaaaccggccgccggcatcaccgccaccgatatggtgctggcgctgaccgaattcctgcgccaacaaaaagtcgtcggcgcgtatctggaattttacggcgaaggcgcggcggcgctgacgctgggcgaccgcgccaccatctccaatatggcgccggagtacggcgcgacggcggcgctgttcttcatcgaccagcagactatcgattacctgaaactgaccggccgcagcgacgagcaggtgaagctggtggaaacctacgccaagaccgccggcctgtgggcggacagcctgaaaacggcagaatacgagcgcctactcacatttgacctctccagcgtggtccgtaatctggccggcccgtccaacccgcacaagcggctgccggtgtcggcgctggcagaacgcggcatcgcggtcaatctggcccaggcgcgcgaacaagaggcgcagggcctgctgccggacggcgcggtgatcatcgccgccatcaccagctgcaccaacaccagcaatccgcgcaatgtgatcgccgccggcctgttggcgcgcaacgccaacaagctgggcctggttcgcaagccgtgggtgaaatcctcgctggccccgggctccaaagcggtggagctgtatttgaaggaagccggcctgctgtccgagctggaacagctgggcttcggcatcgtcgccttcgcctgcaccacctgcaacggcatgtctggcgcgctcgacccgaaaatccagcaggaaatcctagaccgcgacctgtacgcgacagcggtgctgtccggcaaccgcaacttcgacggccgcatccacccctacgccaagcaggctttcctggcctcgccgccgctggtgatcgcctacgccatcgccggcaccatgcgcttcgacatcgaaaaagacgtcttgggcatcgccgacggcaaggaaatccgcctgcgggacatctggccgtccgacgccgaaatcgacgcggtgctgaagcaatcggtgaagccggagcagttccgccaagtctacgagccgatgttcgccatccaccgcgacagcgccgccaaagccagcccgctatacgcctggcggccgcagagcacctatatccgccgcccgccgtactgggagggcgcgctggccggcgagcgcacgctgaagggcatgcgcccgctcgccttgctgccggacaacatcaccaccgaccacctgtcgccgtccaacgccatcctggccagctccgccgccggcgagtacctggcgaagatgggcctgccggaagaggatttcaattcctacgccacccaccgcggcgaccacctgaccgcgcagcgcgccaccttcgccaacccgcagttggtcaatgaaatggccgtggtggacggcgaggtgcaaaagggctcgctggcccgagtggagccggaaggcaaggtgatgcggatgtgggaagccatcgaaacctatatggaccgcaagcagccgctgatcatcgtcgccggcgccgactacggccagggcagctcgcgcgactgggcggccaagggcgtgcggttggcgggcgtggaggccatcgccgccgaaggcttcgagcgcatccaccggactaacttgattggaatgggcgtgctgccgctggagttcaagcccggcgtcaaccgcaagactttgcagctggatggcaccgaaacctacgacgtgatcggccagcgccagccgcgcgccgacctggccctggtgatccatcgccgcagcggcgaaacagtgcaagtcgccgtgacctgtaggctggacaccgcggaagaagtgtcgatctacgaggctggcggcgtattgcagcgcttcgctcaggatttcctggcggcggcgcaagcctgacccacacacagcggccgattcatgtcggccgcgccacacaaaaacaggacggcaaacatgactcacccggctcagattcgcattcccgccacctatatgcgcggcggcaccagcaagggagtatttttccggctgcaggacctgccggaagccgcccgccagcccggcgcggcacgggacaaactgctgctgcgcgtcatcggcagcccggacccgtacggcaagcagatagacggcatgggaggcgcaacgtccagcaccagtaaaaccgtcatcgtgtcccaatccacccggccgaatcacgatgtcgactacctgttcggccaggtcgccatcgacaaggccttcgtcgactggaccggcaactgcggcaacctgtcagccgccgtcggccctttcgccatcgccaatcgcctgatcgacccggcgcgcgtgccggagcatggcatctgcaccgtgcgcatctggcaggccaatatcggcaagaccatcatcgcccacgtgcccgtcagcgacggccaagtgcaggaaaccggcgatttcgagctggacggcgtcaccttccccgccgccgaggtgcagctggaattcctcgacccggcagatgagggagacggcgacggcggcgcgatgtttcccaccggcaagctggtcgacacgctggaagtgccgggcgtcggcgccttcccggccacgctgatcaatgccggcatccccaccatcttcgtcaacgccgccgacatcggctacaccggcacggaattgcaggacgcgatcaattccgatccggcggcgctggcgcgtttcgaaaccatccgcgcccacggcgcgctgagaatggggctgatcaagagcctggacgagatcgccggccgccagcacacgcccaagatcgccttcgtcgcgccgccggccgactacaccgcgtccagcggcaagccagtcaaaacctccgatatcgacgtactggcgcgggcgatgtcaatgggcaagctgcaccacgcgatgatgggcaccgcggcggtggccatcggcaccgccgcggccattcccggcacgctggtcaacctggccgccggcggcggcaagcgccaggcggtgcgtttcggccatccgtccggcacgctgcgggtgggcgcgcaggcccgcgaggaacgcggcgaatgggtggtcaccaaggcgatcatgagccgcagcgcccgcgtgctgatggaaggctgggtgcgagtgccgggcgacgccttctgaggcagccggcaggattcgcccaaaaatagcggggatgctgcgaagcctccccgtttttccattccgacagcgccattgccggcagtttcttgctagatttcgtgagataatgacggccagccggcgcgacaaagacatgaattccatctgcatggccatccgcgccggcccgactgaatctcaaccggaacccgccgccatgagcacccccgcccccatcctgaccgcctccaccgactggcactggagccccacgccctatcccggcgtggacttcacctggctgcgccgcaatccggacggcggcggctcggccttgctcaagctggccaagggcgcgaagctgccgctgcaccgccatcccggcgccgagcaggtgttcgtcaccgccggccggctgaaaataggcgcccacgtgctgggcaagggcgaccatctgttcatcgacgcccatgtcccgcattcggtagaggcgctgcaatccgccgtctatctcaccgtatcggaaaacgacggcgtggaattgctgccgccggaccaggctggctgagccggcggcctggctagccggctagaacggcttgatcgctaccttcagcacgccgtcgcgctggtgcgagaataggtcgtaagcttcgacgatctggtccagcttgtagcgatgggtgaccaatggcgacaagtccagccggtcgctccccagcacattcatcagccgccgcatccgctccttgccgcccgggcacagcgaagacacgatcctcttgtcgcccaggccggcatggaacgcgtccagcgggattctcagatcggtggagtacacgcccaggctggacaaggtgccgcccggcttcaatatccgcagcgccgactcgaacgtgccctgggtgcccagcgcctcaatggccgaatcgacgccgcggccgccggtcagcttcagaatttccgagatcacatccacctggcggaaattcagcgtgatgtcggcgcccagccgccgcgaaatcgccagcctgtcgtctatcccgtccaccgcgatgatgcacgacgcgccgcgcaagcgcgcgcccgccaccgcgcacaaacctatcggcccctgggcgaacaccgccaccacgtcgccgatcttgatattggccgcctcagcgccggcgaagccggtggacatgatgtccggacacatcagcacctgctcgtcgctgagcccgtccggaatcggcgccagattggcctgggcgtccggcaccagcacgtactcggcctgggtgccgtctatggtgttgccgaaacgccagccgcccatcggtttgtagccgtggcattcgcagccgccatcctgcgccggatggccgtcctgacagccgtaggaggtgaagctgggacagatcgcgccggcgatcacccgctgcccttcgcgatagcccttgacgtccgcgcccagcttctcgatcacccccaccggttcgtggccgatggtcagacccgacgccaccggatactcgcccttcagaatatgcacgtcggtgccgcaaatggtggtggtggtgacccgcaccaacgcatcgcccggccccaccgccggaatcggcttctcgcgcagttctatccggcccggcgcgacgaagaccgtcgctttcatgctgttcatggctgcctcccgcatcgatggcggccgaggcgcgaaatggcgccccggcccatgcttcaatacagtagacccattccccgcacgcaagccggccacccgaccgaatggcctatggctgacccaagtcaaaccggccgtggcgccgccgctacctgcgccaatccatgaaagttcacgccgcgcctcgtctttggatccgtttaagggccgcccctgcagcgcaatggcatgaacatgaataacacccgtcgcgcagcatgctgccagcttgatgtaacagctggtttacaactggccgttccgcgtaaaatatctccagataaaataatgcagacggaaaatactcatgaacaagccgatgcgctacgcgctcgccgccatcgccatgtgggcctcagtcgccaccctcagttcgctcacccatgccctgccgcccttcttcgtcgccggcgtcggcttgatcttgggcagcctgttgaccgcgcgccgcgccgcggaatggaaagtgccgctgaaaagcttcgccaatggggtttacggcatcttcggcttctactttttcctgttcaacgcctaccggctggcgccggtgatggatgccaccgtgctcagctacatctggccgctgctgatggtgctgctgtcgccgctgctgctgccgggcacccggctgggcgccaaccacatcctgggcagcctgatcggcttcgccggcgcggcgctgatcgtcaccggcggcaagctgtcgctatcgctgtccgcgctgcccggctacctgatggcgctgggcgccgccgtggtgtgggccacctacagcctgttcacccgccgcctgcccgccacctccgacaacgccgtaggcggctactgcctcgcctccggcctgctggcgctggcgctgcacttcgccactgagcccgccgcccacccgtcggccatccagtggctgatgatcgccgtggtgggcctgctgccgatgggcgcggccttcctgtgctggaaccgcgcgatgcagctgggcgatccgcgccagataggcgcgctgggcaacgccaccccgctgctgtccacgctgatgctggtcgcatccggccaggccgcgctcaacggctccgccgcgctggccatcgccatgatcgtcggcggcgccgcgctgggcacgctgccggcgcggcgcctgctgccccgctggctgcaagcctgaccccgccgccggccgccttgagcggccggcatcgccagtcatttctgcccgccgcgcagtccggcccgcagagagggcccattttcgccccctgtgcccgatcctccctgccacgccaagcgcgtgacgcgcaatcccttgcccggctcccggttaatattcaatcgataaagtctaaaatcatactaattggggaggcctggcatgactttagaccattcaaaacaagtacaagatctctttgtccagcatctgaacggcagcgccaacggcattgccgtgctggacgccgaggatcgctttcttttctacaaccagtccttcatcaccatgttcgcctttgaaggcatttccatgatcggcaagccttatgacgacttgatggcccgcgccttcaatctgcggctgatcgcggaatgcggcaaaaccacgctggaggcctggctggaggtggttcacgcccgccaccgcacccaggaggtgtggaactacgagatggagtggacggacaagcgctggctgctgctgaccaagcaggtataccagcagggcatgatggtgatggtctgcgccgacatcacccggcacaagcagaccgaattggcgctgcgcgccgcccatgccgagctggagcggctggccatgacagacgaactgaccggcatctcgaaccgccgccacttcctcgcgcagatggagcgggaatacgaacgcgccaaacgctaccagcaccccgccagcctggtgatgttcgacctggaccacttcaagcgcgtcaacgacagctacggccacccagccggcgacctggtgttgaaacacttcgccgactccctggccgcccatgcccgcgaccaggatgcgctggggcggctgggcggcgaagaattcgccctgttgctgccggaaaccagcgccgccggcgcgatgagcctgctggagcgcgtgcggaccgagctggcgaacgccagcctggaattcgtcgcgcccggcttttcctacactttctccgccggcgtggcggagttgtccattccgcccggattcgaccgccgccactggattcaggctgccgatcaggcgctgtaccaggccaaggcatacggccgcaaccgctcggtcatctaccgggacggctaggccaggcccgccgccttgatactttctggaacagtttccatcaaaatcatttggactagagttacgaataagcctgcgcgggcctcgcccgccagcctccgcatccaggcaggcacggcaggaggcaatccgcatggccaaacgatgcgacgtccccggcatccacgcctatgacgcgcccgccggcggctgggaggcgccgacaccccgaaagcgaatgtgctgatgccgcccgtcttcaaatccgccccccctgcgcgtgacgcgcgcgaaggccgggcggccggcgcgggcccgggtcggcagatggtttcccaaacaagagcaaatggccatggatctattcgacgcaattcacctcgccagattgcagttcgccttcacggtttccgtgcacatcatctttccggcgatcagcatcgggatggccagcttcctggcggtgctggaatggcgctggatcgcgacaggcgaccgcgcctacaaggacatgtacctgttctggtcgaaaatcttcgccatcggcttcgggatgggggtggtttccggcgtggtgatggcttatgagttcggcaccaactggagcggcttctcccgcgtggcggggaatatcaccggcccgctgctgacctacgaggtgctgaccgcgttttttctcgaagccggctttctcggcatcatgctgttcggctgggagcgggtcggcccgcgcgcgcacttcttcgccacgctgatggtcgcgatcggcacgctgatttccacgttctggattctcgcctccaacagcttcatgcagacgccgcaaggctttgccatcgaaaacggccgcatcgtcccggtggactggctgaaggtgattttcaatccctcgttcccgtaccggctcgcccacatgaccatcgccgccttcatcgtggcgggcttcatcgtcgccgcctgcggcgcctggcacctgctgcgcggccgcgacgacgcgccgatcaagcgcagcttctcgatggggctgtggatcttgctgctgctgacgccgatacagattctggtcggcgacgcccatggcctcaacacgcgccaataccagcccgcgaagatcgccgccatcgaggggttgtgggaaaccgagaaaggcggcaccgcgctgaacctgatcgggctgccggacatgcaggcggaaacgacgcgctatgcgatccaggcgccgcatcttggcagcctgatcctcacccatagctggaccggggagatccgcggcctgaaggaatttccgccgcgggaccgcccctattcgcccatcctgttctggactttccgcatcatggccggcctgggcatgctgatgctgctgacggcgctgctcggcctgctgctgcgccgcggcggccgcctctaccatgcccgctggtttcaacgcctggtgctgtgcatggggccatccggcctggtggccttgctggccggatggatcaccaccgaagtcggccggcagccctggaccgtgtacggcgtgctgagaaccgaagactcggtatctcccatcaccgcccagcaggccggcgtgtcgctgctgattttcgtgatcgtgtatttcctggttttcggcgtgggagtctactacatgctgaaactgatgaagcacggccccgccgcgcatgccgcgcatggcgagccgatggcgcacccgggtttgcacaatcgcgcgctggacatgctggaagaagaggagtaatgccatgcagatcgatcttcccgtcgtgtgggccgcgatcatcgggctgggcgtcttcatctacgtggtgctggacgggttcgacctcggcattggcttgctgtttccgtttttcgagctgaaaaacgagcggcaagtgatgctgaacaccatcgcgccattctgggatggcaacgagacctttctcgtgctgggcggcgccggcctgtacggcgcgttcccggtggtttactccaccctgctgccggccaactacctgcccctgatcatgatggtgatcgggctgatcttccgcggcgccgccttcgaattgcgcgccaaggccaagcgcacacagcacttgtgggacctggccttcatctgcggctcggcgctggcggcgttctgccagggcatcgtgctgggctcgctgctgcaagggatcaaaatcgccgacgggcaattcgtcggcgggccgttcgactggctctcgccgttcagcatcttttgcgggataggcgtgctgatcacctacgcgacgctgggctgcgcctggttgatcctgaaaaccgacggcgaactgcagagaaagatgttttccttgatgcggccaatggccggcaccttgcttggcgtcatcgccatcatcagcctgtggacggtgctgggcttgcccgccgtcgcctaccgctggtttggcagcggccatctcggctggtttctgcccgtgcccatcctggtgctggcgtcggtttggggagtctaccgcgcgatccgccggcaaaatgattccctgccttttctcctgacgctggcgctgtgctttctgggctacagcggcctggtcatcagcatctggcccaacatcattccgccatcgctgaccatatggcaggcatcgtccagccactccagccagttattcgcgctggtcggcacggtgatcatcctgcccatcatttttgtctacaacatcatgcaataccgcgtattccggggaaaggtccgcgaaggcgacgccggttatcattgaacggcgccgcggaatccgcccggcgcgcgtgatgatcatccggccgatgcccaattggttccgcatgctgttcgtgtggaacggctccgcgccgcagtccatgattccccagctgatatttgccgcatcgccaacccgcaaaagcggcgccgcccagccggctcaggtcaggatgtaatggctgcccacccgccaatccgacggcagggcttcatcattcaactccagcacggtgcgttctatggtgcgcgtcatcgcatccagcggcaggccgttgggcgaacaggaaaacggctcggccagctcgctggcgatagactccagcgcgaacaaggtataagacaggaacaccgtgatgaaaggcgtggcgtaactgatgatgtccaccaggccgaacggcaagaacaggcagtagatatatacggtccggtgcagcaataccgaatacacgaacggaatcggcgtcgatttgatgcgctcgcagccgcctatcacattgaagatctcgcccatctgcccatcgcaggccaataactgcatgtccgtcaccaggccttgccgattcaacgcgtacaaggcgcggcgtgtttcatggcacagcacggtcggtttgtacgcttttcccgcgcagctggcattttcaagcgcatcgccgcgcaactggcttttcagcaggctaggcagcagcaacagcttgcggatgatggcctcgccctccgccgccatggccggctgggcgctccgaatggaaatcaccatcgacgccaggctgcggatggcgatcagaaagtgcccccacagcttgcgcgcctcccaatagcggtcgtaactggcattgttgcggaatgccagaaatatcgtcagcgccacgcccaccagcgtgaacggcacggtattcagagggattttatcgccgaacacatgcccatcggtcaacagcgccaccccgctgatcccggccatgaacaaaagctgggggatgatccgccgaataaccgacccctcccaaacgaacagcagcttcagccagctgctttcagagcgcacaatcatcttgcattcctgaatccattaatcaaaccatgcccggcaagcgcccgtaagacgcgaaacggcgtccgccatgcctgccgcgccaatccatgcgggcagaaaggcctgaacccaaaaacctctccccgttgaaatcttgcagcgagtgtcaaacagccgcggcagccgaataagccagcccgccgcccatcacaggccacagcgccatcttaatcagccgtccggcaaagaaagagcacagttccccccatccaacgcaatacagtttcgattgaaacaaaccggctgcaataaaaaacggcactacccgcagggcaatgccgcctctcgcatccaacgaagcatggcggggaaaaacgccgctcagcccccgaccaaggacatccgcaccgtcgggtattttttccgtccgtgctcgcgatattgctcgccgcgccattcggaatagcggtcgtcccgcgcgcgccaggccgacgcgatgacggtctgcaaggcggcgggagaaacctgctcgccaagataggggcgcagatcgagcgagcgattggcgaacaggcaggtaaacagctggccgtcggcggagacccgggcgcggctgcagtctccgcaaaacggcgcggacatgctggagatgaagccgacctcgccgccgccatcggcgtactggaaatagcgggcggtatcgctggcccgctcgaccggcgccgcgatcaacgcatgccgccgctcgatccgctcccgcacctgctccgaacgcaaaacgctggcgccgctccagttggctgcgccgcctacgtccatgaattcgatgaagcgcacggtgacgccgctatggcggaaatagtcggcgatgggcaggatctggccgtcattcaagccgttctgcaccacggtgttgatcttgaccggcgccagcccaacccggcaggcggccgctatgccgtccaacacccgcccgacgccgatgccgacatcgttcatctgccggaaaatgccgtcgtccaggctgtccaggcttaccgtgacccgttccagccccgcgtctttcaggctttgcgccttggcgcccaacaacacgccattggtggtcatcgacacggaaacgctttttcccgccggggtgctcagccgcgccagcgattcgatcaagcgctcgatgtccttgcgcagcaagggctcgccgccggtgatgcgtattttctccacccccagcgcgacgaaggcgcccgccatcttgcgcatttcgtcgaacgacagcagctgggcatgtttcaggaacgcatagtccttgccgaacacgtctttcggcatgcagtacggacagcggaaattgcacttgtcgattaccgacaggcgcagatccagcaacgggcgccgcagcgcgtccaacaccgccattccgctcttgtcttgcgctgactgttcgctcatcacgtccgctctccccgccatgcctcagacctgccccatggacggcaaatgcggcccagtcggcttcatgtgcgccactatagcggctgagcgccgccgcgaacggtacagttgccagccgtactgacagatacagttgcgcggccaaagcgccggctcatgccgcaaacagttcccggcaggcacaaagcccctcctctgtcagccaggcggtgccgacgcagccgtcttcgcgcatcgccacctccaccagcgcgctggcgcgcagatagctcagccagcgccgcagcgagctcatcggcacgcccgactgcttggacagccgggccagcgaccaaggccgctcgcggtccttcagcgcggcctgccacagctgggccagcaccgccagcaagacctgatcgttcggttcgtccatcacgttttccttatcattgcgccggcccccgcatccagccgccggcgaaacgcgtcaatgcggcgccaacgccaccttgccgcggaacaaatggtattggtacaggttgtagccgatcatgatcggcagcaccgtgcctatgcccagcagcatgaaggccagcgaggcgctgttggaggccgccgccgcaatcgtcaacttgcccggcaccagccacgggaataggctgatggcgagcccggcaaacgacgcggtgaacagcaggcaggcgccgacaaacgggctgtgctcgccgccggtgtagacggcgtacagcacatagacaaaggcgagcgccgccagcaggcccagccccatcagcacatgcagggtgccgccatcctgccaccgccccaggccgaccgggctgaaatacagcgtgcccagcgacaccacgatggcggccagcaccgtggcgcacaccgacgccaccgcgccgcggcgggcgcggttttgcagttgccccgtggttttcttcaccaaccaggtcgcgcccagcaagctgtagccggacgccacgcctatggccgtcaccgccacgaacgcgtccgcctggatgccgggcgccaggccgctgatcacccggcccagaatcaggccttgcgccagcgccgccagcaggctgccgaggccgaacacccggtcccagaacgccttgctgccgcgggcgagatggcggaactcgatggacgcgccgcgcatcatgaagctggcgatcaacgccatcaccggcacatacagctgggtcatcagcatggcgtaagccgcggggaaagccccgaacagcgcgccgcccagcgccaccagccaggtttcgttggcgtcccagacatggccgatcgactggatcatcagatcccgttcatgctgcttgcgctggaacagcgacaggatgccgacgcccaggtcgaaaccgtcggtcacgacgtacagcaaaagcatcaggccgatgatgccgaaccaggcatggctcagcagctcctgcgtggaagtaggtgtcatggcagtctttccttaataacaatcagtgggggcagcaggggcgtcagtgttcgaagccgcgcgcttgatccagccgctccggcatggccgcgggacgcagcgccaggtccgggcctttttgcagccagcggcgggcgaacacgaagaaagacgccagcatcacgacgaagaagacgccgaacatcatggtgctgccgctcagcgtagccgcaggaatcgccgatgcggcgtgttcggtgcgcagcatgccgtagacggtccacggctgacgcccgacctcgcgcacgatccagccgcattccactgcgatgtagggcaagggaatggccagcacccaggcccacagcagcttgcgctgcgccagcaggctgtccaggcggccgcgcgccttgcggatcgcgtacatgctccagaacgccagcgccatgaacaggaaaccgatgcccgccatcacgcggaaggcgtagtacagcaagggcagcatcggcggctgatcggccttgggaatgtcgcgcaggcccttgatctgcccatgcagcgtatgggtggccagcaggctgagcatgccgggcacctccagcgaccagtcattacgctgccgttcggcattgggccaggcgatcagcgaccaattggcgccgctgcccggcgtattggtttcccaatggccttcgatggccgcgcccttggccggctgggtttcaaacacatccaccccgctggaatcccccaaccagatctgcagcggcgcggcgatcgccagcaacagcaaggccaggcgaaaagaccgggcgaagaacgccggatggcggcgcttgagcagataccaggccgaaatgcccgccaccaccaccagcccggtctccatcgcggcgaaccacatatggctgacgccccacaccatgtccgggttgaaaatggcggcgagatagtcggtcaccaccagcttgccgcccaccacgatgacgccggccggggtttgcagccaggaattggccaccatgatccagaacgccgacagcgaggagccgaaagccaccatggccgtggcgaacaagtgcatctggcgggacaccttgtcccagccgaacatcatgatgccgacgaagccggcctccagcatgaaggccatcgcgccttcaaagcccaggatgttgccgaagaactgcccggtgtattcggagaacggcccccagttggtgccgaactgaaactccatcgggatgccggtggcgacgccgacggcgaagttgagcagcagcagcttgctccagaaacgggcgtggtggtaccagacgagattgctggtgcgcacccacagagtttcgacaatcaccagaaagccggacaggctgatggtgaggatgggccacaagatgtggaagatcgcggtcagcgcgaactggccgcgcgcaagatccagggattcgacagacatatcaatcaccatagggaaagccacagcccgccttgcctgccgggctgccgaaattcaggaaaagcgcgtcaaaacgccggcatcaccggcggcgcggcggacaggtgcaacagcaccggtatcgatttggacgtcggcgtgttgcagacatcgcccacgctgtccagcggcaccagcgggttggtttccgggtaatagccggcgatgcagccgcgcggaatgtcgtagctgaccaggcggaaataattggcgtggcggtcgatgccgtcctcccacaccgtggaaatgttcacccagtcgccatcctggaaacccagcatggcgatgtcggccggatggatgaaaatgacccggcgctggccgaacacgccgcgatagcggtcatccaacgcatagatggtggtgttgtactggtcgtgggaacgggtggtcatcagcgtcatcagccgttcgccatgcagcttgcgggcgcggctgatcggcgtgtcgcgctgcaccgggtgggcgatgaaattggccttgccgctggcggtttcccacgcccgctcgcgcgaggccacgcgcagatggaagccccccggctgctggatgcgcgcgttgtagtcttcgaaaccgggtatcacccgctcgatggcgtcgcggattttgccgtaatcgcgcgcgtattccagccacggcgctttggcgtcgcccagcgtggcatcggcgatatgggcgatgatggcggtttcggacaacagatcgggcgaggccggcgtgttcataccataggagatgtgcaccatgctcatcgagtcctccaccgtgatgccctgcgccacgccggagcggtcgtcgatttcggtgcggcccagcgtcggcaggatcagcgcggccttgccgtgcaccaggtggctgcggttgagcttggtggtgatgtgcacggtgagatcgcaggcgcgcaggccctcgaaagtgcgcagggtgtccggcgttgccatcgcgaagttgccgcccaggccgacgaataccttcaccttgccgtgcagcatgtgttcgatggtttccaccacgtccaggccgtgctcgcgcggcggctcgaagccgaacacctcgcccaggcggtcgagaaaagccatcgacggcttttcctcgatgcccaccgtgcggttgccctgcacattggagtggccgcgcaccgggcagatgccggcgccttcgcggccgatatggccgcgcatcatcagcagattggacaacagctgcaccgtttgcagcgaatgcttgtgctgggtgatgcccatcccccaggtggcgatcacccgctcgcccgcggcgtagatgcggcccaggttttcgatgtcggcgcgcgcgacgccggattcggcctccagcagcgcccagtcttcccggcgcaggtcgtcggcgaaggcgtcgaaccccagcgtgtggcgctggatgaagtccctatccagaatgcccggctcgcccttggcgcgggcctcgtcgtcgcgcgccagcacatatttggccacgcccttgatcagcgcgaaatcgccgcccagcctgggctggatgaaggtggaggcaatcggcgtgctgcccatggtgatcatctcgatcgggtgctgcgggctggcgaagcgctccaggccgcgctcgcgcagcggattgaccgaaacgatgatcgcgccgcggcgcgccgcctcgcgcaattcgcccagcatgcgcggatggttggtggccgggttctggccgaagatgatgatggtgtcggccttctcgaaatcgtccagcgtcaccgttcccttgcccacccccaccgtaccgggcaggccgcggctggtggcctcgtggcacatattggaacagtcgggaaaattgttggtgcccagcatgcgcacgaacagctggtagaggaaggcggcctcattgctggcgcggccggaggtgtagaacgccgcctggttcgccgagggcaggcgattcaaatgcccggcgatgcattcgaacgcctgcggccaggagatggggacgtatgtgtcgctggcggcgtcatagctcatcggctcggtcagccggccgtgctgctccagctcgtagtcggtctgctgcatcagagactcgacggtgttctcggcgaagaaggccggcgtcacgcgcttggtggtggcttccgccgccaccgccttgacgccgttctcgcagaattcaaacgtggaggcatgctggcggtcgggccaggcgcagccggggcaatcgaagccatccggctgattctgtttgaacagcatgcggtaattcccgcccgacacccgttccttgatcagattgatcgccacatatttcagcgcgccccagcccgcggcgggatggtggtagggttcgatctttcccggtggatttgacttgtccatgacctggcttccatgatccgcgcagtcgcaaggcccggaaatcgggactcattctgcgccgtattgcatggaggagaggttaagagcaaagtccggcggcggaagtgtacacatcgcgacgatatcgcagagtacagtttgacccacgtcaaggccccaggcattgctatgatggtagcggccaagccaggccacccgcagaacccaagggacgcagcgcatgaaaatgtatgaaacgctggcccgcgaactggagcagcatgtgatgtcgggcatgttgaaagccggcgacaaggtgccgtcagtccggcaattgagccagcaacgcgacatcagcatcaccaccgtattgaaggcctactcgctgctggaaagccggggcgtcatcgaaagccggccgcaatccggctatttcgtgcgcaaagccacgctcgccggccatgccgccgccatgccggcgccaatgccgcccacgctcaggccccatccggtcgccagcaatgtcgagatcagccagctggtattgcgcaccttgaaaaccatcagccggcacgacgccgtgccgctgggatcgccctatcccgaccccacgcccttccccttggtcaggctcagccatctggccaacaatatcgccaaaaagagcagcggctggggcgtgctaaatgacttgccgccgggcaacatagacctcatccgccagatcgccggacgctatttcctcaatggcctgctggtggatcccgccgaagtcatcatcaccgtcggcgccaccgaggcgctgaatctttgcctgcaggccgccgcccggcctggcgacaccatcgccgtggaatcgccgacctactacgccatcctgcatgcgatagagcgcatgggaatgcgggcgatagaaattcccaccagcggcacaagcggcatggatgtggactacctggaaagcatcctggaatcggacaatatcgctgcctgcatggtgatgccgaattttcacaatccattgggcatcgtcatgccggaagcgaacaagaaaaagctggtggagatcatgacccgggccaagaagcccatcatcgaaaacgcggtctacaacgagctttactactccgacacgccgccaagctcgctcaagcaatacgacaccgaaggctatgtgctgcattgctcgtcgttctccaaaaccttgtcgtccgcattccgcatcggctgggccatgccgggcagataccgggaaaaggtcgagaacctgaaattcgtcaatacgctcagcacctcggccattccgcaaatggccatcgccgagtatctgtcgcaaggcggctatgatcagcatctgcggaaaataagaaaattctatcagcagcaggcaaaaatcatcacccatgtggtgagacggtttttccccgaggcgtgcatcatttccgagcccgccggcggctatttgctctgggtgcagctgccgccgcatattgacgcgatgcggctgtacaacgaggcgctggagagaaaaatcaccataggcccgggcaccattttttccaataccggaaaattcagaaactgcattcgcctgaattacagttattcatggtctaaagaaatcgaatccgccatcgtcaccctgggaaaaatcatttcccactacaaatgaagccggcggccaggggcaaggcagccaatcgcgccgccgccatccggccgggcggctcggatgattggtcgaacggcgccggaggagtatcatcccgccctgtcttcacgcaaaaataaaaaggggctgacatggcaaaacactggggcaaggtgctgacggcgatggtgacgccgttcgacgccgacggccggctcaatcttgacgcggcccgcgcgctggcgcggcgcctggccgacaacggcagcgatggcctggtggtggcggccaccaccggcgaagcgccgaccctgtccgacgccgaacgcttcgacctgatccgcgcggtcagcgaggcggtgaccatcccggtgctggccggcaccggcagcaacgacacccgccacgcgctggcgctcaccgcccgcgccgaggagctgggcgccgccggcgccttcctggtgtcgccgtactacaaccgcccgccgcaagccggcatcgaggcgcattttcgcgcgctggccgccgccacgcgcttgccggtgatgctgtacgacgtgcccggccgcaccggccgccgcatcgcccgcgacgtgctgctgcgcctgctgggcgaggtggacaacatcgtcgccttcaaggacgccaccggcgatccggccgccgccgccagcctggtggccgaggccggcgaccgtttcgagctgtactccggcgacgacgcgctgaccctgcccctgctggccatcggcgcggtcggcgtggtgggcacctccacccactggaccggcccggagttcgccgcgatgatcgccgccttcgagcagggcgacgtgcgccgcgcgcgcgccatcaacgcggcgctgcagccgtcgttcgccttctccaataccgacgactctgtgtactcgatgtcggtgaaggcgatgctgcgcggccagggcctggccgtcggcgagtgccggctgccgctgccggccgcgccggaaaacgtgggacggcaggccgccgaagtctggcgccggctggaagcctggcgcgccggccaacgctgagcggccatcggcaataaaaaaggagacccgagggtctcctttttcacggttgacgcgccgcgcggcggggatcagtcgcggaagttgttgaactgcagcggcgagccgttttccaggtcgtcgccgatatccttgcgcagcagcgcgatggcttcctgcagcacgtcgcgcttggcgccggacaccctaaccgcctcgccctggatgctggcctgcaccttcatcttggaatccttcagcagcttgacgattttcttcgccaggtcggaatccaggccttccttgatcttcaataccttcttcaccttgttgccggacactttctccagcttgccgtagtccaggctgcgcacatcgacgccgcgcttggccagcttgcccaccatcacctcgttgacctggtccagctggaactcggtgtcgccgaacagggtgacttccttgtcgttgaactcgatgcgggcgtcgctgcccttgaagtcatatcggttgcccacttctttgttggcctgatccagcgcgttgcgcacttccaccttgtttacttcggaaacgacatcaaaagacggcataaaacgtatcctcgctaataatcagccgaattctagttgcgcccccgcggcttgtcacccgcccattgccaaagccggcgcggcatgctgtgatcggagccaaaccaaccatccgcatcaggacatccaaccatgctcgtcaccctgccccaactggccgcttttctcgccgccgccgtgctgatcacgctgtcgcccggccccgacaacctgatggtgctcagccagggcatctcgcgcggccgccgccacggcatggccttcggcctgggttgcgcgctgggctgcctcaaccacaccgcgctggccgcattgggcatcagcgcgctgatcgccgcctcgcccgccgccttcgccgcgctgaagatcgccggcggcggctacctggtttacctgggctggggcgccatccgcagcccgggcgtcggcttcgatgccggcggcgatggcgcgggtccgcagggttcgctggccgccaccttccgccgcggcctgatcgccaacgccatcaaccccaaagtggtgctgtttttcctggcctttttgccgcagttcgtcaatccggcgcaaggcccggccgggctgcaaaccgccatcctgggcacgctgttctccgcccagggcgcgctgatcttcggcgcgctgggctatttctccggccatgtcggccaatggctggccagaagccgcaagaccggacagtggctggaccggacggccggcgccatcttcatcgcgctggggctgcgtctgatcctggcgcgctgaaaactcaatagaaattaattactattccagattggcaaacacattggcgggggcagatgctaagctgaatgagcagcattaagtttcaaatacccaataggattattaaaatgagaatattggcgactttctttatgcttattgccctcagccctgccgcctacgcctacatcgaccccagctccaccctgtttgcctggcaaggcgctttagccctgctgggcggactgctggttttcgtcaaagcccccgtctcctcgctcaagcgcttgttgcgccgagtcttcaagaggaaagacgacgatcatgcgtgacccgctaggccacctggaactgaaggaacgcaccgccgtccgctcgctgtacgccccgctggagccaagccactacttgcacagccccctgtcgcagcagctggtcggccagggcatgctgctggacttcgactttctgggcagctccggcatcgtctccgaacggctgcccttcgtcagctacccgcacgaatggtcggcgccgcaattgcgcgacgcggcgcggctgacgctggacatctcccgcaacttgctggaatcgggctgggagctgaaggacacctcggcctggaacgtgctgttcaaaggctgcgcgccgatcttctgcgaccacctgtcgttccagcccatcgccagccgccactggtgggccttcggccagtatctgcagcatttcgtgtttccgctatgcgtcgcccgttatcgcgactttccggtcagcgacagcttcctgctcagccgcgacgggctggacgccgcgcgcttccgcgcgctgatgggcacgcgcatcttcgccacccgcttctggccgctggccctgggccgcggcagcggcccggctaccacggcaatctgtacagcctgctggactggtttctggcggctaccgcgcgccagagcggccgtagcgcctggatagactacgccgccaacaatacccattacccgccgacggcccaggaggccaagcgcgccttcgtcagccagtggctgaaccggctcaaaccggcctgggcggcggatttcggctgcaataccggcgagtattcgcaactggcgccggacgctggcgcggaagtcatcgcgctggacgccgaccaccgctgcatcggccagctttacgacacgcatccgggacaggcccgcctgcacccgctggtggccaatctggacgatctggacggcggccgcggctggggcggcgccgaattcaacggcctgcccgcgcgcctggccgcggtgacagaattggcgctgatgctggcgctgactcaccacctggcgatttcgctttccatcccctaccgcaagatcgccgaattcgccgccgcctccacccggaaatggctgatcgtcgaactgatcgaagaaaacgatccgctggtggaacggctatgccgcgaacgcaagcgccatcccgccgaatttccgctgtcgctgcagcgcgccgcctttctggaacgcttccgcctgctgggagagcagcaattgcccggcatcggccgccacctgctggcgctggaaaaacggcaagcatgagccgccgcgccgacagctgggtcctagcgctcgccatcgcgctgggcgccaccgtctgctggctgccggcctggcaggccgcagcgcgctaccatggcggctacagcgtcgccgaaaccgccgcttacctgctgctgccggcgctggcggctgtcctgctcgccggcatggcagccgcgctgggcgcgcgcggccgccagttgctgtgcgcgctgctgctgctcaccgctctctacctgcttcacaagtttgtccgcggcctgctgcccgccgccccggccttgccgcccggacggtcattttcctgctttgcgccgccagttggctggcggcggcgcggctggccgacgcgttctggcggcagctgggccacgtcgtcatcgccgccgccctcctgttcgcgctcactccgtatgcgctgctgatgagcgaccaggccggcgcttacccggtgttttcgctggccagcccgtacgccctggcctcgcccagccgcaacaccctggcgattctgctggacgaaaccggacccgagttcaccgcgccgctgctcaaggccgcgcaggagcgccaattgcgctgggccagcgtcgtggttcccgccgccggcgccaatactgtcaacgccatccccgccatgctcaccggtaagcgcttcgacaacgtggcgccctgcggcccaagctggctgtgctcgcccacccgttcgctggatttcggccaactgtacgccggccggcccgacctcgacatcgtgggtttctggcacccgtactgcgccatccgcggcctgcgctattgccgcaggatagccggcgtattttatccgccgccggcgcgatcctttctgtgcagcccgccctacctcccggcgctgctgaactgccggcccgccgccggctcgcgcgacgccgccgtcgacaggctgctggcggccgcttacgccgcgccgttctggcgcgagggcggcatgctctacctgcacctgcccctgccccatcccagcatggaaacccgcgagaacctgcgcagccactacctggccaatctggccgatgccagccaggtgctgggccaactgctggacaagatgcgcggccgtttcggcgacgacttctccgtcatcgtgacatccgaccaccctttgcgcaccgagggctggtgccggcccgagcgcgaataccacgccgcggactgcagcctcgggctgccggccaaccgcaaacaagtgcctttcatcgtgatcagcccgcggctggcggagcagccgcgcatgcctgccgacaatctgggcgtgtttcacggcgccgcgcgcagttgacggcggcttgccgccgcaacatcatcccatcagcattgcccgaacgcagcgtctccccaccacaaggaatcagccatgtccctcaccatgcatcaagccgccattcccgcgctgacgcgcggcctcaacagcctgtcggccattctggccaaggccgccgcccacgccgaagccaggaatatcgacccccaggtgtttttgcaagcccggctggcgccggacatgttcccgttgctgcgccaggcgcagatcgcctgcgacctggccaagggctgcgccgcccgcctggccggccaggaggtgcccagctacgccgacgacgaaatcggcttcgacgatttgcaggcgcgcatcgccaagacgctggcgctggtggccggcgtgacgccggcgcagctggaaggcagcgaagaccgcgcggtgacgctgaaagtgcggggagaagagataacattcagcggcctgggctatctgcgcaatttcgcgctgcccaatttctatttccacctgaccaccgcctacgccatcttgcggcacaacggcctggagctgggcaagcccgactatctgggcggcgcgcccgccagcctcgccgaataagcgcggcaaacggcaaaaagccccggacgccagcgccggggctttgtcttgactgcctgcaggcctacttgcgcagcaggaattcggccaggatatttttgaacacgaagcctgacacgccgaagcccagcaccaggaacaacacaaacatgccggttttgcccgccttggacttcttgcccaggtcccagatgatgaagcccatgaaaatgatcaagccggtcaggcacaccaccagcgaaatattggtaaattgctcttcggacacgatttcaacccttgtctgctttcatttgccctgccggccgggccgccggacggaagcggccgccgcgcaacaccagggccacgcccgccgctgccagtacgataccccccatcgccaatgggctcaagcgctcgtcgaacaacagccaggcctggatggcggtgaggccaggcaccaggtagagataagccgccaccttgccgacgtcgccatcgcgcagcatgcgcatcagcagcaggatggccagcaccgacagcatcaacacgctccaggccagcgcgaaaacgaactggccactccacgccacgctctggccgcgctcgaacagcaaggccagcaggccggtcacggcgaaagccgacaggtattgatgaaaagccccggcgatggggtgcgcgccgccgccgcgatgtttctggtacagcgtgccgccggtgatcagcaacagcccgcccgcggcgaaggccgccccggcgccgccgccgaaagacacgcccttgctgccgagaatcaccagcgccgtgccggccagccccagcgccatccccagccactgcccggcgcggaaacgctggccgcccagccccatggacagcaaagcggtcaacaagggttgcaggcccatgatcagcgcggccaagcccgccggcacgcccagcttgatggcggcgaacagacagcccagataaccgccgtgcagcatgccgccgctgacccactggctgcgcatctgcgccagggtcggccacgcgggccgcaacgcggcgatcaggccggcgaagcacaatagcgtcagcgccatgcggatggcgaggaaggtgaaggggccgcaatacggcaaacccaacttggcgccggtgaagccggtgctccataacgcgacgaaaacccacggaatccaactgcttgcccgcatggcgcggcctctcctaatctattgcgcaaagaacgaaaaatggcggcctgggccgccatgtcaacggtattaaccgattgtatcagccgcgcttgttccgcgcattggcggcgatgcgcatccgcaaggcgttcaggcggatgaagccggcggcgtcggcgtggttgtaggcgccgccgtcttcgtcgaaggtggcgatggtcgggtcgaacagcgaatcggttttcgattcgcggccgacgacgatcacattgcccttgtacagcttcagccgcacccatccgttcaccgtggcctgcgacgcgtctatcatctgctgcagcatcgcgcgctccgggctccaccagtagccggtgtagatcagctgcgcgtacttcggcatcagctcgtccttcaggtgcgccacttcgcggtccagcgtgatcgactcgatcgcgcggtgcgccttcagcatgatggtgccacccggggtttcatagcagccgcgcgacttcatgccgacatagcggttttcgacgatgtcgagacggccgatgccgtgcttgttgcccaggcggttcagctcagtcagcaccgcggccggactcagcgcctggccgttgatggcgacgatgtcgccgtgcttgtattccagctcgacgtattcagcctggtccggcgcgttttccgggctgacgctccacagccacatgtcctcgtccggctcgcgcgccgggtcttccagcgaggtgccttcataggagatgtgcagcaagttggcgtccatcgagtacgggctgccgccgtttttcttcttgctgatgtcgatgccgtgggcttcggcgtaagccagcagcttctcgcgcgacagcaggtcccactcgcgccacggcgcgattaccttgacgtcgggcttgagcgcgtaatagcccagctcgaagcgcacttggtcgttgcccttgccggtggcgccgtgcgacaccgcgtcggcgcccacctggttggcgatcgcgatctggcgcttggcgatcagcggccgggcgatggaggtgcccagcaggtattcgccttcatagacggtgttggcgcggaacatcgggaacacgtagtcgcggacgaactcctcgcgcagatcctcgatgaagatgttctccggcttgatgcccagcgacacggctttctggcgcgccggctccacttcttcgccctggccgatgtcggcggtgaaggtcaccacttcgcattgataaacgtcctgcagccacttgaggatgacggaggtatccaggccgccggaataggccagtactactttcttgatgtcagacattgctttgcttcccacgtattgtttgcttgtcgattgccgggcgggactcagtcctcgcggtgccccagcaacagaaattcgatcagggccttttgcgcgtgcatgcggttttcggcttcgtcccataccacgctttgcgggccgtctatcacctcggccgccacctcctcgccgcgatgcgcgggcaggcagtgcatgaacagcgcgtcgggcttggcgtgcttcatcagctcagccgtcacctggtagccggcgaaagcctcgcgccgcgccgcctgctcggcctcgtaacccatgctggtgaacacgtcggtggtgacgatgtccgccccgctcgccgcccgtgccgggtcttgcgtcagctccaggagctccgagccgtaatggtggccgtccaacgccttcagctcgtagcccagcggcgacgccaccttcagcttgaagccgagcacgcgcgcggcctgcagccaggtgcggcagacgttgttgccgtcgcctatccaggccacggtcttgcccttgatcgaaccgtgccgctccacataggtgaagatgtcggccagaatctggcacggatggtattcattggtcaggccgttgatcaccggcacgcgggaatgcgccgccagccgttcgacctggcgctgctcgaaggtgcggatcatgatgatgtcgctcatccgcgacaacactctcgcggtgtcctccaccggctcgccgcggcccatctgcgagctcttggtgtccagaaacatcgcatgcccgcccaactgggccatgccggcctcgaacgacgcgcgggtgcgggtggagtgcttttcgaacaccatggacatcaccttgccgaccagcggccggtgcaactcgccggcgccttgtcgtcgcttcagaaccttggttcgctcgaagagatggtggtactcgtcgggagtcaggtcgctgaactgcaggtaatgccttacggacttcatgatgctccaatcggaaaaaaagaggccgctgcgcgtgcaacaccgagaggtgatttcatgcgcaacggcacattactacacgctggtctcaagtcactttaacaaacgccgcaccccagacaggacaaagtcatgatttacagaaatgcgacatttgttatatttatcggaaatcaccctgcctgacaagcattcaattgaacaatcctcgtcccggcaattccgccaactcggccggacgcagcacgcgcacgtaaaattcgccgccatcctcagccaaaccatgcatttctatggttttctgtgttttttgcagccgcgccaaatacgacaagatggtgtcgtctatcagctgccccggcaccagcaccggaatgccgggaggataaggcacgatctggtcgcaacacacgcggccgcacagctcggcattgggacggccatcgtcgtccagcagcggcaaccgttcgccggcctcgtagaaggcgtcgcgcggcaggcaggccaatcggctgaaatgcgggatctccggcatccgccccagcgcgcgcgccggacggttttccttcgccagccgcagcatcgcgtcgtacagccgcgacagcttgctgcgggtggtgcctatggtcagcagcagcgtgatggtgctgaacgtcgacttctccacctggacgttgtaacgctcgaacaaggcctgctgcagttcgtcggcggtgaagccggaacgggtgaagtccaccgtcagcttggtggggtcgagctggatgccgtcttccctcacctcctccggcagcaagtcggccagctccagtacgcggaacacgccggtggagttgatcttctcgcgcaattcctgcgccagcttcaaggtgcggtccagcaggcggtagccttccatcaccgcctgcttgcgcgccacgtccaggctggcgatcaagttgtactgcggactggtggacgcgtgcatgttgaagttttcgcggaacagatgcgcgtcgaaaccgggatcgttgacgtggatcatgctggcctgcgagaacgcggacaggatcttgtgggtgctctgggtgacgtaatcggcgccggactccagcgccgtcggacggaaggccgggtggaagcgggcgaagccgtaccaggcctcgtcgacgatcaccttgatgcccttctcgtgcgcggcctcgatgatgggcttcaggtcgtagcgcaggccgtcgtaggtgcaggaggtgaggatcagcacccgcgcgtccggattggcatctatcgcctcgaagatggtggtcttcggcaccggcccgaaaatgccgtactggcgattgatcgacgaatccagatacaccggcagcgcgccggaaaggatcacgccgtgatggaccgatttgtgacagttgcggtccagcagcagcttgtcgcccggtgccagcagcgtctggaagatcaccttgttggatgtcgaggtgccgttggtggcgaaataggtcttcttcgcgccgaaagccttggccgccagcatctgcgactccgcgatcaccccggtcgggtgcagcagcgaatccagcatcggcaccgacaccgacaggtcggcgcgcagcaggtgctcgccgacgaaatcgtggaaatcccctacccaggggctgcccttcagcgagtcgccgccggaatggcccggggtatgccaggagtccttggccatccgcacgtactgcttgagcttgtcgtaaaacggcgtggccgacttttccgccagctcggccgccagaatgcggaaccagccgttgaaatcggcctcgtcgcggtagaaatagccgtccaccgcgtggctggccagctcttccaccagcgcccgctcgtcatcgtcctgcagaaacacgtaaagcgagacctccggccggaacgcgctgatgcggttggccagctgggccgccgcctggttcgcgccggcgcctttcaattggcggtcgaccagcacgacttgcgtttcgccgtcgcgcgcgatgaggtccatggtttcggcgctggtcgccgcggcgacgaaggtcaggccgaacggattttccagccgcaccgctgcagccccaagtccggccagcacttcggcttgccatgtcacatcatcgctgaccacgagaacgcggctgacgggtttcatgatggtttctccagttgtgttgccgcgcgttgtttttgtctgtccgggccgcgcgcgccgctgcttgtttttctgttgttccgcctatcctatccacatcttgccgtcgccgtcattatgcaggcgcacaaaggccgcatgcgatacaattgcgccatgctgaccgatgccgaaaaagacgcgattcgcgaccactaccgtaccctctccgacaacctgccgggcttccgcccgcgcgcctcgcagcggcggatgctggccgaaatcgccaacaccctctcccgcgcccaggagaaggtggacgacgagtggccgcagcgcgaaggcgaaagcatcgccgtgatcgaaggcccgaccggcgtcgggaaaagcctggcctatctgctggccggcggcgtgatggcgcgcgcgcgcggcaagaaactggtggtcaccagcgccaccgtggcgctgcaggagcaactggtcaaccgcgacctgcccttcgtggtggaaaacagcggcctgccgctgagcttcgcgctggccaaaggccgcggccgctacctgtgcccgtaccgtttgtacgggctcaccgcccagcacgcgcagcaaagcctgctgcagcccgatccgatgatggcgctgtgggaccacaagcccgaacaagccgaactggacgcgctgtcggcgatggccgacgccttccactaccgcaaatgggatggcgaccgcgacaactgggacaccgtgatcgaggacggcttgtggtcgcgcgtcaccaatgatcgccacggctgtctgaaaaccgcctgtccgaaccgcgccgagtgcccgttctacctggcgcgcgacacgctggaaaacgtcgacgtggtggtggccaaccacgacctgatgctggccgatgtctccatgggcggcggcgtgatcctgccggcgccggaagaaagcttctactgcatagacgaggcgcaccatctggccaaaaaggcgatcaaccagttcgccgccgagcattcgctggcgcaggcgctgggctggctggacaaagtggccgccgtggtggtccacgccgaagcgcacaccggcaaggccgagctggccagccaggcgatagactccgccgccgcctgcgtggaaaccctcaccgaatggctgtggctgctggagggcgaggacgcgctggccgccagcagcgacaatctggagccctcctggctgatagaagacggcatcctgccggaacggctcaaaacgcccgccgccaatatggccgtttccgcccgctcgctgtccaaacagctggacgacatgggcaacgcgctgtcggaaacccgcaaggacaagaatggcgacggcgacctggacaagaccgccaccgagctgggcttcctgatcggccgcgcggaacagctgatggcggtatgggatttgttcgataccgaaaccgccgaaaacgcgccgccgatcgccaaatggatcacccgccgcgccgaaggcaagggcgactacctgttctcggcctctccggtgagcgccgccgccagcctggccgccacgctgtggcgccgcgcctgcggcgccgtgctcacctccgccacgctgcgctcgctgggcgatttcgagctgctgctgtcgcaaaccggcctgaaatggctgcccaaggtcagctgcctggccctggattcgccgttcaacttcgatgagcagggcgaactgtacctgccgccgctgcaggccagcccgaaagacccgggcggccacacccgcgagatcatcgaatggctgcccaagctgatcgacccggcccaggcggtcggcaccctggtgctgttttcttcgcgcaaacagatgcaggaagtggccgccgggctgccagccgagctgcgcgatcgcctgctggtgcagggcgaaatccccaagcgcaccctgctggacacccaccacaagcggctggaagagcagcaatccagcgtgattttcggcctggattcattttcggaagggctggacctgccaggcgaaagctgcgtgcacgtgatcatcgccaagctgccgttcgcgatgccggatgacccagtgggcaagaccctgtcgcgctggatcgagaaacgcggcggcaaccccttcatcgaactgacggtgccggaggcgtcgatcaaactagtgcaggcggtgggccggctgatccgcaccgagcgcgactatggccgcgtcaccatcctggacaaccgcctgacacggcaaagctacggcaaaaaactgctggcctcgctgccgccattcaagcgcatatgattttcaggtatgatcacgaaactttcgcataagtaaaaatcgccggccgacaaaaaacgccttagcagctgcaacaaaacaggctacaccaaaagcacacacactggttccaccgccatgatctgcaatccatacgaaatcgtcatccagggcctcacctccgagggccgcactttccgccccagcgactgggcggaacgcctagccggcatcctggcctccttcgacaccaaccagcgcctgtcctaccacgcctatgttcgcccgatgctgctggaaggcgtgcgttgcgtggcagtcgacaaaaagctggaaaaagtgcatccgcagatctaccagttcctgatggacttcgccaaggacaatgacttgcgcgtggtcgattgtcggacactaattgacgaagtctacccgaacaaattttcggcataattgcaacaggcgtcgtttttccaccactccttttgccagtttggaaacactcccgtcatattctgtggttaaactcagacaaagttgtgaagcagtcgtgcgatagttgttaagcagacacgaagacttcaccgcttcaccacagaacctcagacttgacttggagtatcctcatgcagaagaagaatctggcagccttggttgcatctttgttcatcctcccggtggccgcccacgccgacgtcaccatctacggtttcatcagcgccggcatcgaatccgccaaagccaccggcaacggcaacagcgccaaggattacacttcccgcacccgcgtgagcgatcaaaactcccgcatcggcttcaagggctgggaagatctgggcggcggcaccaaggccatctggcaagtggaaagcagcctgcgcaactttgagaacggcggcaccaacgacaagggccaaaccgcgtccttcggcacccgcaacaccttcatcggcatcgacaacgccgacttcggcaaggtgctgctgggtcagaacgactccgcctacaaggtgttcaccggcagcagcaacagcgcgctgggcaccgacctgatggtcaataccaccgccgacaacttcggctccagctcggtcaacagccgcggcgaagcccgtctggccaactcggtccactggttctccccgaaatgggccggcttcacgctgggcggctcctggggcgtggatgaagcccgcgttgccggcaacgactccaaacgcatctcgctgggcctgggctacaactggggcggcctgaatttggccactgcttgggataagcagtatgacatggcggtaaaaaacaatagcaacggctacaacacctccccgaccaacgacccggcggtactcgccctgaacgctggcaagaacgtttccttctacagcatcgcagccagctacaaattcgatttcggcaccttcatcggcggcaactacgaatggggcaacttcgatcagatcggcggcggccaagtgaagcaggatgactggctgatcgcgctgggccaagacttcggcgccgcttcgatcaagctgtcctacggccaactcggcacgctgaagaatgtcggcgccggcgttaacggcgacgacttcaaggccaagcaatggatcctgggcggcacctataacctgtccaagtccacccaactgctggcctacgccaccaaaatcactaacaacgcccagtccaaggccaactttgccaacaatccggtctacgacaacaacctcggcacttcctctgccggcctgaccgcaggcaatagcccgcaagctttcggcatcggcatgaaggtagcattctaagcgtccgcctcccggtcgccatcaaaaacgccacggcatgccgtggcgtttttcttcccctaccgctgcaggtcagttgcagactctatccaactcccctggctgcgacaccaggaaattcccttctccctgccactggatgatgcggcgattgcgctgccgctcccattcatccaccggatacttgcgcgcccaggcgcacatcagctgcttgtcctgctgactgatgcgcaggccatagcgctggtgcatatacagcgtgatccgcgcggctgaaccgcgaacttcctcccgcggctggaaacgcttctgcttgaagtccactagcgactggcactggccgtaaatggggcgcggatggatttcccaggcgccgtaggagaaattggcgcgatcaccgttgacctctcccaccgccggcaccagattgttcagatcgccctccgccatctgaaacagggggtccgtatcgccgcaagctttgcggccgcctttctgccagcactgacgttgatgccccaatacccaggccggcaccacatgctcccactctatgcggctggcgcggctttccgacttgcgcggctgataaccgcaggaggcccaatccaccgccttgccttgatagcggcaaccgcagtagaagtccacctccatgccggcatacaccctgggcaggatgcgcttggcagcgggaaaatcacgatggccaacctccttgccgccgcgcaccagaggcgccgcctcaacagctggcgcatcaggcaaagcgtgctcccccttggagctagtcagcaaagcctgacccaaggccgcaagctgccgcacttctcctgatttggctaccgactccacctgccgcgaatcacacgccgcgagcagcgcgcttaaaactatccataccgatatacgcatggcccgaagtgtaagcatccgaaccaattacagcaatattattgccaaaataaacagcccgcgactcgcgccgcgggctggaataagcagaaggcaaacgcttaccagatgcggatgcgctgatcttccggcttgaacatcttgtcgcccggcttcacttcgaaagccttctggaacgcatcgctgttcgaggtcgccccgatggcgcggaacgcttccggcgagtgcggatcggacaccaggcgcgacaacagcgcttcgtcccgcaccttgccgcgccaaacctgtgcgaagccgtagaagaagcgctgatcgccggtcatgccgtcgatcaccggcgccggcttgccgcccagcgacagctgataagccttgtaagcgatctgcaaaccaacgttgtcggcgatgttctcgcccagcgtcagcttgccgttgatgtgcttgccaggcagcggttcgtaggcctcgtattgcgccaccagcttgttggtcagttcatggaagcgcgccttgtcttccgcggtccaccaatcgcgcaggttgccgtcggcatcgtactggctgccctgatcgtcgaagccatggctgatttcgtgcccgatcaccgcgccgatgccgccgtaattggcggcgtcatccgcctgcgcattgaagaacggcggctgcagaatggcggcgggaaacacgatttcgttctggctcggattgtaataggcattcaccgtttgcggcgtcatgccccactcggtccggtcaaccggcttgccaagatgcgacagctgccactggtattcgaagcgattggcgcgcttgacgttgcccaccaggtccccggcttgcaactgcaggccggagtaatcgcgccaatgatccgggtaagcgatcttcagcatgtacttagacagtttgacctgggccgcctgcttggtcgccggactcatccagctcaagccgtctatgctttgccggtacgcctgcatcagattggccaccagctcctgcattttctgcttgtgctcggccgggaaatacttggcgacatactgctcgcccagcgcctctcccagcgacgactccaccagctgcacgccgcgcttccagcgcgggcgctgctccagcgtgccggacaaggccttgccgtagaagtcgaaccgcgcatccaccagcgccttgttcagatagggcgcatagccatccagcgtatgggcgatcaggtagtcctgccaattgagcagcggctgcttccgcagcaattgcgccaagccgctcacatactccggctgattgacgttaagcaccgccagatcggccgccccggcctcggcgaagaagccatgccagtcaagcttgggcgccagcttcgccaactgggcgaccgtcatcttgttgtagcgtttttgcggatcgcggttatccacccggctgcgttgcagctgtgccagctgcgtctccagcgccaataccctggccgcgcgcttggccggctgcgcgtaacccgcctgcttgaacaactgctgcagatagaccaggaaggcggcgcgcgccttggcgaaacgcggatccttgcccagataataatcgcggtccggcatcaacaagccgctctggtacagctccggcaggtaggacttggcatccttggcgtctatgccgacctcaaaagccaacggcaaacgcgcgttgcctgcctgcccggcgccgagcagccgcaacagctcgttccgactggacaacaaggtaatggcctgcaggtccgcctctatcggctgcaggccctttttctccgccgcggcctcatccatgaagctggaatagagcgcgccgatcttctgcgcattccccgccgcgccgctcgcggccgatgccgtctcgatcaggctgcggctgcgctcctcgctcaggtcgcgcaactccttgaacgcgccctcccaggactccgccgccggaatttcatgggtatccagccacttgccattcaccgccagatagatatcgtcctgcggacgcacatccggattgaaattcttggtgtcgatgccggaaagctcgtgcgcccaggcctggccggccatgaccagcgccagcaccatcagtttcaatttcattcttctcctccttgtccaccgtgataaagaaaggcagcccgaaggctgcctttccacacgaacagatgacggcttacttgacgaactgttccgatccgacgatgcccagcttcgtcaaacccagacgctgcgactccgccagcaccatcgccaccggctcgtagctcgcgtccttgttcggcttgatgtgcagctccggctgtggactcgccttccccgccgccgtcagcttcgcctccagctgctcccgacccgccagcttctcgccgttccacagcaccgaattgtccggcgctatgtcgatctgcaccaccaccggcttctccagcggcttcgacggcgtgttcaccggcatgtccagcttcaccgcgtgcgtctggatcggtatcgtgatgatcagcatgatcagcatcaccaacatcacgtcgatcaacggcgtggtgttgatttccatcatcagatcgtcttctcccgacgaccctacattcatcgccatgtcttttctcctagttccgcgccggaggctcggtgatgaacgcgatcttcacgatcccagcctgctgcaccgccagcacgatgcggcctatcggcgcgtacttcgccgccgcgtcgccacggatgtgcacttccggctgcggcgtcttcttcgcttccttcaccagtcgcgccagcaggtcttcctggctcttcatcggcagcgtgttccagtaaatcgtgttgtgcgtgtccacacccagcacgatgttttccggcttcgtctgcgtcgggatgttctgctctttcggcagcgtcatcttcaccgtttgcgtcaccaccggcacggtgatcaggaagatgatcagcagcaccaacatcacgtccaccaatggcgtggtgttgatcgccgacagcacctgatcctcgtctcccttgccgtggccaaagcgtttataacgggccatggccaattaccgggtcgggttgttcagcaggctggcgtgcagtcggccggacaccacgcgtacgttgtccagcaccagcttgttgcggcgcaccagccagttgtaacccagcaccgccggcaccgccaccgccagaccgatcgcggtcatgatcagcgcttcgcccaccggaccggccaccttgtcgatggaggcctgccccgaggtgccgatcttcaccagcgcgtggtaaatgccccataccgtgccgaacaggccgacgaacggcgcggtcgaacccacggtggcgatcaccgacaggccgttttgcatgtgatggctggcggagtccaccgcgtcagaaatcgccatcgacacccaggtgttcaggtccacgcggttggacagttcgcccttgtgttcgctcgccgcttcgatgccggcttgcgctaccgcgctgtacatgccttcgtccgccagttcgctggcggctttttgcaggtccacgccgtggtggcccagcaattcgtgaccctgcttgatcaggcggcgttgctccagcagcttgacgatgcccacgtaccaggtggaggccgacatgatcagcagaatgatcagcgtgccgcgcgccacgaagtcgccttgcgaccacagcgcgtcgatgccgtacgggttgtccgtggtcaccgtctccgccgccatcgccggcagcgcgctcagcgccgcggccgcagccagtgccttgcccagcagagcttgtgtgaatttagccatggtatttactcctttgtgtcttgagatgccctggtcttaggagccagagtcgagtttgaagccgaattcctgcgtcagctgggaattggcctggcaggtgtagccttgcaatgcggcgctgatcgccgacttgaagctgctgcggtagcgcggcgggatgctgccgtcgaaaccgatattgctgatcccgctgaatttgccgtccgcgcctacgccgaacaccacccgcaccacgccctggatttcgtcttcctgcgctttgctcgggtactccggcgcttccaggtggctgcagttggctttcgccgaaatcggccctttcggcgcttccaccaccggcgccggcgtcggcgcgggttgcggcttcggatccgatgtcaccgactggatcgcgttcgccgattgcacgaccggcggcggattcacgaccggcggcacatacgcttgcggcttcggcgccgccgtcggctgcaccactttctcgatcttcggcggcggcggcggtggcggcggcggcggttcgctgatcaccgacacttccactttctgctggatcaccttgaccacgccttgcgccaagccggtcaccagcgcgtagatcagcacggcatggaatatgatcaccccagccaagccggcgaatcgtcgccttggcggagggcctcccactcctttagctgtgatactcgtcatttgggttacccgttcgttcaaagccggcgagccgggcgctccgtcctcatgagccgaaacgcccatgcccgccgacgattacaacatcaagatgcggcaaaaccgcatccccttgctacctaacacttgggtttggcacccatgacagaatgctatacctatcgattaaatacaataggcatagactacagtttgtacgacgttttgataaagaaggcgcgccccaccggatcggtcagaaccgggtcgaaaccatactggaacgacttggtctggttgctgaacggcggctgctgatcgaacaagtttttcacccccgccgtcaccgtcagtttcttcttccagacatagctgccggacaggttccagttcgagtaggagcgcacgctgtggttttcgtcgttcgggttcatgtcggtgtagccggacgaatagttctgcaccagcgaggcgctccaggccgacttcgcccagttgaaggccaggctatgcttccagcgcagcgtcggcagcaggatgttctgataccagccgcccagcgggctgtaatacacgccgtccttttccaactgctgcacgtacttggaggtgtaggtgccgtccagattgacgctgaaatcgccgatggcggttttcggcaggcggaatgccaggctgacatccacgccggccacgctcagattgcccaggttctcagtcggggtcttgacgtagtccagcgagccatccggattgcgcacgaagcggtcggcgtacttcgccggatcggcgaagatggcgcccggatccagcgtgcctatgctgttctgcaccatggtccaccagaagtccgcgctggcggtcaccgccggcaccggctcgatcaccaggcctaaggtcagcgaagacgctttttccgccgccagggtgcggctgccgccctgcatcaccatgaactgctgattgcaatcctgcggcttgttgccgccgttggctggcacgccgcccgggcaacgcaccgggtcgttgaacttgtcggcgctataggttttggagtccggcatgaacacgtcgtacagcgatggcgcgcggaagcccttgctggccgagccgcggaacaacacctgggaaaccggctggtacttgaaggccaccttggggttgaacgagttgccgaaatcgttgtagtggtcgaaacgcgtggcgacctggacatccagccccttcagcaccgggatgtccgcctcggcatacagcgcggacacattgcgctggcccgaagtggattgcgaattggcgatgcccgagccgatggcgttcctggccgccgcctggatctggctatccagcttctcgtggcgcacttcggcgccgatcgcggtcgccagcatgccggcgggcaactccagcacctccttgctggccttgaagtcggccagcgcggtggtgtacttggcgatccagccgtcgccggacaacttcacgctatcccacgcgcccggatcggaaggaccgaaagggttgatggtgccgttcttgaacgcgttgcggatcaaggtttcgttggcatagccgctctggtaattgatggtggttttgttttccgaatagatggccccggtccggtagtcccagccgcccagcaagccctcggcattgaaggcgatccgctgcgtgtcggaggtgctcttggtggtgcgcggccccagcggcaccgagcgcgcgttcaataccaccgggctgccatcggtaggcgtgccatccggcaaggtggttggataatatttgtcgcccgccaccagcgtggcgatcttcgccagcggggtcggggatatccgggtggtgctgatattgcgcgcgcccatgtactgcagcgacagggaatgatcgccgatctgcttggtggccttggcggtggctgtccactgctccacctccggcgtcagatccatgaacagcgtggacatctcgccgcaggaattggcatccagcggctgcgcatagggcggctggcacttcggcgccgccgggttgtaaccaacgcccttgtaaataaagttggcggggaaaaccgagccactcaggttgtccgcagtcagattgttatgcgcgtagctgcgctccaaggtggtgatgcgttgggtcttttgataagccagcgagccatagacattccagccgtcctccgccagattgccgacgccgccaatcaggttgaagttgccggtattgccgccgcggtgctcggtggacaggatttctccgcctacggtcaggccggtaaccgacttcttggtaatgaagttgatcacgccgccgatggcgtcggtgccgtaaatcgcggaggcgccgtcgcgcagcacttcaatgcgttcgatggccgaaagcggtatcgcattcaggtcggtggcgtagccgctgatggcctggctagcgaccctgcggccatccagcagcaccagcgtgtactgcgaacccaagcctcgcaggctggcataggacgcgccgccgctcacgctttggaccgaagacgcggacaccatgccggactggttgctggccagcgaattcaccacctgctccaccgtcgtgaagccctgcttggtcgcctcttcagtgcggatgacggtaaccggcagcgccttctcctgtttgatgctgcgcttgatgttggagccggtcacttccacgcggtccagctctccgttgccgtctgccaacgccagaggagcatgcgaaccaatgcctatcaaagccagcgccagcgccagctgtgttcttttcatcacggaacttctccttcacgctatttcccgagccctgtctgccggttctgtggccggcatggcaggaggtacagacacgccatgcatgtgcatgtcatgtttcgagtgtgtgaagagttcgcacaatgcgtcaatctcggtaatagtcagtcataatttgcaaagcgctccgacattggccgccctgcccggcttccgcccatgacgacggtggcggcaggatgcgcggcggcaagcaaatccagtgccggctgcacccttgtccttgttcggaggttgagaatccccctcgctcgcaccgcgtcgccttatcaacaatccatgtcggattttttcaataaatgttgtttttttacaaaataattctctttatttgtaaaaaagaaatttattgttcactaacaaagtgagtaatactcatatttacaatcaaaaaaaatcacctccccaatcacaagccccctggcaaccgctcccttccgtgccgaggccataaaaaaaaccggcctcgcggccggtttgtctttccttcccctgcgctcaggccggcgccagcgccgcgctccacccctgcggaatcgcccccagcagcttcttggtgtagctgtccttcggctcgcggtagatcacgtccgcatccgcctgctccaccacctgacccttgttcatcaccagcacctggtccgagatgtgcttcaccaccgccagatcgtgcgaaatgaacaggtaggacagcttgtactcgtcctgcaggtcctgcagcaggttcagcacctgcgcctgcaccgacacatccagcgccgataccgattcgtcgcagatcagcacttccggcttcaaggtcaggcagcgcgcgatcgcgatccgctgccgctggccgccggagaactcgtgcgggtacttggccagcgcgcccgccggcagccccaccttgtccagcaggtccagcgccagcttgcggcgctgcccgccgtcctggccgatgccgtgcagcagcatcggctcggtcaggatctgctcgacggtgaagcgcgggttcagcgacgcgtacgggttctggaagatgatctggatccgcttcttgtaggcgtggaacgccttggcgctcatgccgatcaggtcctggccgtggaacaaggccttgccgccggtggcctggtgcagccgcaccagcgtcaggccaacggtggtcttgcccgagccggattcgccgacgatgcccagcgtcttgccgcgcgccaactggaacgacacgtccttcaccgcgtggaactggcgcttgccgaacagcccttcgcggatgtcgaagctcttgcacagcccttgcacgtccagcacgatttcgtcgccggcggcgtagccacgtgtcctttcggccggttcgacatagccgcccggctggaggaagtcgtcgatcaccgccagccgctccgggcggcggtccaggtgcggccggcacgacagcagcgccttggtgtaggcgtcctgcgggttttcgaagatctgcttcaccgtgccttgctcgcggatcacgccgtggcgcatcacgatcacttcgtcggcgaattcgccgaccacccccaggtcgtgggtgatgaacagcaccgacatgccgtgcttcttctgcaggtcggcgatcagttgcaggatctgcttctgaatcgtgacgtcgagcgcggtggtcggctcgtcggcgatcagcagcttcggttcgcaggcgatggcgatggcgatcatcacccgctgctgctggccgccggacagttcgtgcgggtaggctttcacccgcttttccggctccggcaggcccacttcgcgcagcagctccaccgcgcgcttccaggcggcggaacggctcaagccggcgtgaagggtcagcgtctcgacgatctgctcgccgacgctgaacaccgggttcaaggagctcatcggctcctggaaaatcatcgcgatgtccttgccgcgcagcttgcgcagctcgccgcgcgacagccgcagcaggttgcggccctggaacagcagttcggacgccggatcgatctcgctggattgcggcggcagcagctgcatgatggccatcgacgtcaccgacttgccggagcccgattcgccgaccagcgccaccgtgcggtgggccggaatgtcgaagctgacgcccttgagcgcctcgaagcggccgccgtcttcctggcggaaacccaccttcagattgcgcacggacagcaaaggtttgttgttgctcatcgggtgatcctcactttaccttggggtccagcgcgtcgcgcagggaatcggtcagcatgctgaacgccgtcaccagcaccgacatgaacaccaccaccatcgccagttgccaccaatagccctgcagcaactcctccggcacctcggccagcatcgatccccagctgacctggcgcacgtcgacgccgaagccgaggaaggacaggatcacctcgtatttgatcaggccgaccatcagcaaggagaactgcaccagcagcagatgggagatattgggcaggatgtggacgaacatccgccgcgcgctgctnaattaaagataccaataaagatgatgtgggaattttgacgagtaggtagtactcctaataatatttttgaaaataaggagctaaataggaaaagtagatcggttggatggatgatatgaaagtggctaaattggctttcttgggtgttgtgcttgtggtggagtctggctgtgttgtgttttctccgcagtggccatggcaagatgctaaaaattacccttgttcgaagatcagtacagaaccctgtactcctgaagatgcgatttctacttatattaaggcaactacattctgtcgacaggttttgaattactatgaatctggcggtgaacttgatgatggttctaagcttttagtcgggtcggttggggcgctttctggctcggtactgtcggtggttgcaaagggaactgctgcaaaaggctggtctgggatgtctggggcggcgaatggcattcaggctacaatggataaaactttttcaagcattgtgtcttacaagaaaatggatgcggttaatcagtcgtatgcacatgatgtttcggttatttttaatgaaagcggtagtgataaccctgtttcaaataacaaaatagttttcggatcgataatgatggcagcagactgtgcaatgggttcttccaaagttgatgctgccttccttcaacagattgctgattttcctataagcacccccaagccaaataaaggggttgatccaaaaaaacagactgatgcatctgcatctgctccggcatcagcgtctgcgagtaaataacctagagttttaatatgcaaatccagcaagatgtccaaggcttcatccttgatgcaagggtggagctttttcaattggccccgccacccggcacgccatacccggtgcagtacttcacgccggccggaaccgatgccaataccaatgcgatcagcttcatgggccagcagtatcagccctgggcaatccaggcagagggattcgagaaaacagtgcagggcagtgcgccgcggccgacgctgtccatcgccaatgcggtgatgggcgctaatggccccatctatggcatctttacccagttggtccgccagttccgaggcttggccggctggcgggtgacgcgcatggtgacctacgccaagtatttggatggcggcgcgctggccggcgctccagagttccaccagcaggaaatctggtttgtgaaccggcggacccaggatgacggcacggttctgcagtttgagctggtgagcgcgctggaccttgaaggcaagacagtgccaaacaccatggccagcgtctattgcccggcccagacgcagtaccggagcgcggcgtgcggctacgccggcgctgccatgttcgacgtcgatggcatgcctacgaacgatcccagcaaagatgcttgcgggaagcacttcagcgactgtcagcgccgggggaatcagaccaactatcccggattgctggggctgcggcgctacggttaagcgatcccaatccaataaacaacccgcttcggcgggtttcttcatttctggggccctgatgatcaacgaaatgctgcacctggcggagctggcgcacccgcaggaagcgtgcggggtgttgctggactccggccgtgtctacccgtgcagaaacattgccggcgatccccgcgcgcaattcgagctcgatccggtggactatgccgccgccgagcagctgggccgggtcgttggcatctggcacagccacccggacgacacggccgacccgagcatggtggatcgtgtgatgtgcgagcgaaccgggctgccctggcacatcgtcagctggccgaatggcgagcacacgctgaccgagccaggcggctggcaggcgccctacgaagggcgcccgttctgctggggaatgttcgactgcttcagcctggcgcaggactggcatcggcgcgagacgggcattcagttgtcacgggcgcaggtggcggaagagttctggctgaagggtgacagcccgttcccggcctggctggccagcgcgccagtggatgtcgtggagggagagcccgtgcgcggtgacctgatattcatgatgtgcgaggccaacgtggtcaaccatgtagccgtctacctcggcgatagccgaattctgcatcagctctaccatcagcccagccaggtcggcatctatggcggctggtggcggcgctgcaccgtaaccgttgtgaggccacgccatgagtgaaaaacgtaccgtccgcctcggcggcgagctgggcgagaagttcgtgaagcaggtcgccgcctacgtggatagcgtcggtgaggccgtccggatgctggacgcgaactggccaggattcatccagcacctgcgcgacagcgatccggaaaaagtgggataccgggtgaccgtggctgaccgggatgtcgttgaagaagatgaactggtgctggtgagcaagggtgacatcctcatcatgccggtaatcggcggagccagtgcagggttgcgggtgtttgccggcgccgtcatcgctgttgtcggggcatactttggccagccttgggcggttcagctgggtgtagggatgatgattggcggggccgttgagttattgacgccgataccgaagcagcccgactggcaggccaaggacggcaagccgaactactggttcaacggcgcgcagcagaccagcgcgcagggcctgcccattccgattggaaccggcaccatgctgattgccggcacggtgatctccgccggcgtcagcgtcgaggacatcggcaccggggcgctgcccagcaattcccctgtactcatatagcccgccacgcgcgggcatttctgttttggagcatgaatgtccgacgatgcaatctttggcgccaagggcggaggcggcagccagcacaccccggtagagtcgcccgatactgcgcagtcgatcagctacggccgcatgatggtcctgctgagccatggtgagacgggcgggccggcggacgcggccaacccactgaagagcatctatctggatgatacgccgatccaaaaccaggacggctcgttcaacttccagaacatgcaggtctcctaccgcaatggtacgcagacgcagccggccattcaggggtttcctgcggttgaaacagagattggcgtcgggctggaggtgaaggctgcgaacccgatcacccaaaccgtggcggatgtgaacgccaccgccatccgggtgacggtttcgttgccggccggcctccgatcgacggatcagaaaactggagataccgctggcgcgtcggtgcaatatgcgattgatctggcaccagcgaatggggccttcgctcaggcggccattgtcaccatctccgacaagaccgcggccaattatcagcgtagcactcggctgcagctgaccggcgccgggccttggctggttcgggtccgccgcatcacgcccgacagcacgacgcagtacctggccgaccagaccgtcttcacctcctttaccagcatcatcgatgcgcagctacgctatccgaacctgactgtgcttgccctcaagttcgactcgcgccaattttctcggatgccgacggtgtcggcgctgtggcagcagctgaagtgccaggttcccagcaactatgacccggtggcgcgcacgtacaccggcccatgggatggtaacttcaagccggcggtgaccagcaatccggtatggttcttgtggacctactgcacggacaaccgcttcggcatcaacattccggccgccaacatggaccggtgggggatgtacgccattgcgcagtggtgcgaccagcccgtcccggatgggtacggcggcaccgagccgcgcttccagttccacaacttccagcaggacacgcaagacgcctggaaggtcgtgtccgacatcgtgtcttccttctgtggccaggcatactggtcggccggcggtattcggattgtcgcagacatgcccggcaagcagccggtcaagcacttcaacgccaccaatgtcattgaaggcaaattcacctattcgtctactccgaagaatggccgctttaccgcggcgtcggtagcctggacggatccgggtgaccgctaccggcgcgcagttgagtatgtcgagcatggccagggtttgctggcttatgggctgcagcagaccgcggcggtagcgatgggggcggtgacgcgaggccaggcgcgccgctgcggccggtacattttggagacggcgcagcgcagcaccgaaatggtggtgttcaaggcggctgcctatggtgcggatctccagccgggtgacctgtttgcaacgtctgacttccacgtgaccggcgcgcggatgggcggcagggtggggtcggtcgccggcacggttgtcaagctggatgcaccggttacgcttcaatccggcgtgacctacacgctggaggtgaccggacctgacggcgtgccggttcgccgcggcgttgtcgcgtcgcctggcacaactgacaccctcaatatcgtttcgcagtatccagcccagccggtcgccggcgcgacctgggtgctgatcgctaccaacctgcagccggacttgtggacctgcgtgtccatcaagtcggtagacaacggcgagttcgaaatctcaggcctgcagtacgacccgaacaagtgggccgcgattgagacagggctgaggtttgacccggcgcccaccagcaacctgccagatccaggtgtgatgccggcggttctagcagttcagttgcaggagcagccctacctggcgccggacggtagtcggaaggtgaagttgctagtggactggccggcggtcgtgcatccctacctgcgtggctatcgggtgacctatcggcagaacggcggaaactggattgcgctgccggaccaggtgagtaatcacgccgaaatcatggatgtcgtgcctggcagttacgacgtacgggtgtcctcggtgtcggtgactggggtggtcagcatcccagtgacaggcaaccaacagacgcaggggcaggtgacaccgccttcggcacctacgctctcggcggcaggcggagcgatgaaggtagatttgacctggatgtatcctgccggccggcccgatatcaagcgggcagagctgttctacagcaccacggcagccgatccgaaccctggcaaactggcggatgtcagttatccgactacggcttttaccttccagggtgctcaactgggcgtgacgtacttcttctggctgcggatctacgacacctgggggaatgtctcgtcgtttgccacagcccaagcccagacgatgaaagatcccacgctgctgctccagcagttgcagggcggtgtcgactacagcttgttggcgccggatctggccggcagcatcaccagcaacgacaacgtggctaacgcgctgttgcaagcgctgctgcaggttgacacgtcctggtcgcaagcgcgtggcgcgcgcgtgatcagcggccaggctacggccgccatcgtgaacgagcagaaaatccgcgccgaccagaatgcctcgatggcgtcgaatatctcggcactccaggcatccgtcgccggcaatgctgcggcgatcacgagcgaatggatggcgcgcgtcaccgccgatagtgctgtggccagccaaatctctcagatgcagacgacgctcattggcaacagcgcgaccattacccagcaggcccagagcattaacggtcttcttgggcagtgggcggtgcaggtccagcttgacgcgaatggccaaaatcctcgcgtggccggcattcagttgagcaatgggcagggggggtcatcgtttgcggtcctcgcagacaagttccaggtcgcgtttccggatggctccaacccgcgggcggctttcacggttggccgaatcaacgggcagactgccgtcggagttgacggatccatgattgttgatggctcgatcagcggccgaaatgcaatcgtttccggctctatcgatgcggggcagatcaacacgcgagggctgaccatttgcgatgcggctggcaatgtggtggtcgacatgaccgggatgggcgctgcctatatcaaggggcagctgactgtcggccagattgacacccggggcatgacgatcagggatgccgtggggaatatcgtcgttagcatgaacgggatcgacggctctttcatccgcaacctgatggtggacaccttgcagatcaagggggaagcggtcagcaagaacgacacccgcagcatcacggtcagcggctggaccaatgccttcgactactcgttccagttcaactgcagcgattccggcacactgctggcgtttgcggattctccattcacgacgccgatacctacgctatacggtcgcggacgctcggcgcccatcaatggcagtgcggtgctggtgctgaatgttaatgcaggtgaggtggtgacgattggtgtttcctcgcctgcgatcaatgtgagcggcatgattcgctatggctgcgtgttgttcaggaggtagcagatgcccatcgatatcatcgaatacgacgacgccggccgcatcctgcaggtcggcaccagccggccggagaatatccagctggacgtggccgccggcaagcgcatcttggtcggcgcggcagacccattgacgcagtacgtgcgggacggtgcggtcgcgccgcgcccgctggccggcgcggtgctggacggcatgacgctgcggcagttgccggcgccgtgccagctgatactcgacggcacgccgtacccgtgcccggatgaggtgtgcgagttgtcgttcgcgcatcccgggcgccaccaaatcgtggtcgatgccttcccaatgcaaaccgctgtttttgaggtgacgacatgatgaagatccaccacgctggcgaccacgccgcggcgcgccgccagcagtacccggacattggcgatcagctggacgcgctgtggcgcatggtggccgacgcgccgcccgaccagttgccgccgcaaacgaaggcgatgctggcggagatccaggccgtcaagcaaacctacccgaagccccgcgatgacagcggggcttctcctttggaggtgtgatgtccgcatcaaacccaactcccgcagaccttgcggcatcgctagcccagttgctccagaagtacaacgtcacgatggaccagttcaatgcctggctgaccagtgccggcatggtgacgctgaccgacgccgccggcggaactcacacggtgcccagcgccgccaatgtgctgcgcgctgacggctccaatgccagcggcacctggcccatctcggtgtcgggcaatgcgggctcggtcagcagcgtgactgctgcccaggtggccgctggtctcggctatcaaccggtgcgacaggacagcattccagacacaaaaggagcgatgtcctatgtccagcttggcacattcacttgcggccagaatggcgccaagctggctttgtcggttgtttttggcaatggatacaacgcagccaacagccagctgggcatggcgactctgatcttcagcacgagcaatggcggtgcccagcagccaggctctgccggcccattttttggtgccgcgacggccatggttttcggcaacagcggctgcacgtttctgatcgcgcagaacagccctacgtcgtacacggtatttgtccagctccaggcttgggccggcgctggcggctgcagcgcgtttggggatgcctcgaatggaggctgggtggcaagcgtggtgaataccggcagcaaattgcccgctggcaacctcctgacggtacagccgcaaggcattttgacggtcagcagtttcaacacgacgccaactcctgctccagcctacacccgggcaactgcgccggcggcggcggcctacgctggcgcattggtttacatcacagacgccactggcggcgctgcgctggcatggtcaaacggcaatgcctggatcagcgtcagaaccggcaaccctgtctgaggacaccatgaatcaatatccctatgaaatccttattcggctctctgccgctggcattgtcggcgcatcggtacgattcgcggcagatcagcccaaccccctgagccagcagctgcagacctacatcagcgatccccagtctcttggtgtggcggatggtcagagcggcctgaagctggcggatgtgctcgggcaggtggctaccgtggcgctgtcgcaaaatcaggcattgcagctgcaattggcagacgtgcaaaacaggctggcggcattgccggagggggcgaagtgatctggatcgcgcttttcattctgctgcagctggccgacatcgccagcaccaactacgcgctggtccgcctgaatgggagggagctgaatccgttcgtcaggcgcctgatggcacgcgttggcatcctgccagcattggtggcgagcaaggcatttctgttctttgcctgctacctgctcgcgccaccgccactggcctaccaactgctatgcgcgttctacgtgttcattctgttccgcaatctgcgggcagttaaacagggccgggattcccggccctaatcattcctggagacaccatgctgaaaaaactgcacgactatcgcatctacctgctgatccttccggccgcgctggcgctgttctggattgactccgttgttgcccaaacctggctgcagctgggtttggcgttgccggtgctggtgggcgtggcgctgctgctacgcaaagcgctgttccatgctgacatgtcggaggccgccgacattgctctgcacgcgcctactggtgctgctctggtggtgctggccgaccgtttgttcatggctgcggtggtgattggtggtgtgttgtggctgcggggctgagcgccggcgcgctggccctgttgccgctgctgaacaccgctgtgactcagcactggcccgacatgccgtcccgctctgtgctggcggctcaggttgagcaagaaagcggctggcgtgtcaacgcaaagctgcagacgtcgcgcgagctgggcgccggcctggggcagttcaccaaggcgtacaaggcagatggctcggttcgcttcgatgcgattcgagagatggtggttgcgcatccagagctccgaggctggagctgggcaaacgcttatgatccgcgctatcaactgccggccatcgtgctgaagaaccgtggcaattaccagctgatccgctgggcagcttccgacgctgaccggctggccatgatggacgcggcctacaactccggcctcggaggggtgatccagcgccggcggaagtgcgccaatacttccggctgtcagcctggcgtctggttcggcaatcttgaacgcagcagcgcgcagtcgaaggctcggcatgccggctacgggcaatcgtttgcagatatcaccaatacgcacgtcaggaacgtgatggtcgtgcggaggggcaagtatcgcgcttactttggggagtaggggatgggtgatgaagttgtgctgccgcgggaagagttccgggcactgctggaggcggcggccaaggccggcgcgcgccaggctctggacgaggccggagtggctgatgcagtgaagctggccaagagagtggatggtgtggcggatgctgtgctgaaggcattggccggcggcattgtgattggcctgctgggcgcgatctgggccggcatcgtagttctggccaaggcaaaaggagggtgaacatgtggagggagatcgtgctggccgccgccgtggcggccttggcttttctggggtgggagatgcgggctgtgctggcccagcgtgacgctgcggtggtgcgcgccagccaggcccagcagcaggcagtggccacccaagccgcccggatgcacgagcgccaggtggcagcagatgacgcggccacggcggccgcctacgaaaaggatttggaagatgggaaacttgaattgcaagccgctctggctcgccatgctgctgctctccggctgcaccagcaacagcccgccgccgggcgcggcgatctgcccgcagctgccgccagcgccggccagcgtgatggtgccgcgccagccgacttttctgcagcgcatggagacgatgctctccggctcgccgccgaggcagacgacgtcgtccggcaactcagcgcctgccaagccctgatccggtcggacaggcagtaatccggcctggcggcatgtcgaaggcatgctgctgggcgttatttattttctatttcaccatcaatataacgatcaataaactttcttgagattgattgcacttctacaatgtaattcataagtccagcaccgtttgggatggatattttggcagaaagtattatttcatcaatgtttttattgatttttgaaatggtaatgacagcaaatctacctgtaacggtattgcaattattgcaatcgcatataattttatagccacgatactcttctattaaaatgcctggatcagtttgggtcattccttttcctttctccatttctaatttgactatgtgatttttctgaatttttctctatttcagttgtataggcagtaacactgccagtagtcaagacaccccggaaaagcagccgtataccaaaacctttcttatatggcagttatcatcagaatagttgacaaaataaaattatgctgcagcggccatctgtagccccccctttgcgagtccgagttaagcgactatgctttgcgcatgtgcgtaaatttcattccacccacggcgcagcagatccgccagcattttggctatgaggtcgacgatggcctctggaagcctgagtgctggcaggactatgcagcgccgatcatcacccgtgacgggctgaagctggcgacctatggcttcgtgccaaagcgccatctgccgcctggcgttcgcttcacaaccatgaacgcgcgcgctgagaccatcggggagaagccgacttacaaggcagcttggcgcaagtgccagctctgcctcgtgccgatgcaagccttcttcgaaccctgctacgagtcaggaaaggcagtgcggacgcggatcggactggccgacggccagcccttcgccgtggcgggcatgtggcgcgagtggcaagagccagagggggcggttagctacgctttcacgcaaataaccatcaacgcagacggtcacgaggtgatgggaaggatgcaccggcctggcgaagagaagcgctcattggttattgtgccgaccgaacattatgaggcatggttggagtgtccgaatcctgatgtagctcggagctttctgatactttcaggtgcacatttgttggaaagcgcaccaatgacaaaataaagtggctaacgcaattgcattgacatttattgttgatcgtgatattgtttcggaattcttgcagtggtatttgctagggttggtgtccggttcgaatcctggacatggtgtttggtgcatttttactgtgctcttgattttgactgttttcttgaactgtgttgatgtttttttgtgttcagaaacaagtaattcgtcaaagaaagaggggttcggtatgaaaaaatgcaaagcttattttatttatttcgttattggctgtgttcgtagtttgagcgcagtaagcgccagcatcgtggcttcggtagccaccacagggcaaggcttggctggttttatccagcagcccttgcaaatatcattggtctatttcacttccagcaattcatcaagccgcgtcgtatagcgcggcgacctcacatcctgcctcatctgccagcgctgagtcatgttctcagacgccagtcgcaccgtgccgcggccgaattgtcgagtgatggcgtccattgttcgcatcagcagctctcggcgcggatctggcggcgccgcaaacagatccgactgcaccacgcctcgcgggctgatctccatcagcacgattccagctttgtggtagaggtagcctttcttgtagatggcccgcaggcccgccagcgccgcgcgcgtgatttcgagggtgtcgtcagacgcctggaccagcggcaccacgatatagggccggtactgcgccacatcgctgaatgggctggtgcgaatacccacgccgaccaggcgcgccgccgagccctgggcgcgcagcttctcggccgcccgcgccgcgtggtgcgagatggacgcgatcagggtgttcaggtcgcgcaccttcttggaaaacgaccggctggcaatgatctgctgcttgctgggtgtcacgtcttccagcgccaagcagctgacgccgttcagctcctgcaccgttcgttcgaccaccaccgagaacgcgcgtttgatgcgccgcgggtcggcctgtttcaggtggagcgcactgtgaatccccatcgcctgcagctgctcggtcagccgacgcccgatcccccacacatcgcccacctcaatctgcgccatcatctggtcggcctcggccggcgtcacgaagtcccattcgaacacgccggcccatttcggttgcttctttgcgatccggttggccaacttggccaaggtcttcgacggtcccatgccgacgcatgtggggatgccgacgcggcgcagcaccgcctcgcgcatccggtggccatggctgtccagatccggcatgcctgtcatgtcgaggaaacactcgtcgatgctgtaaacctcttgctcggcagcaaactccgacagcacccgcatcatgcgccggctcatgtcgccatacagggcgtagttgctggaaaacaccgcgacatcgtgctggcggcactggtcggcgatctcaaagaaggggccgaacatcttgatgcccagtgccttggcttcggcgctggccgccaccacgcagccgtcgttgttgctcagcaccactatgggcttgccgatcaggtcgggccggaacacgcgctcgcaactggcgtacatgctgttgccgtccaccagcgcgaaaagggttggcgcgctcattgccggaacttcttcactgcaccggtcactacgccccataccagcagctcttggccggaatgcagggtgatcggcgcataggcggggttctccggcatcagcgcacaggagccgccgcggctgtgtagtcgcttcacggtgaattcgccatcgatcacggccaccacaatgtcgccatgcgccggcgcgagccccttgttcacgacgagcagatcgccgttgtcgatgccggcgccgatcatggagtcaccgcgcacacggacgatgaacgtcgccggagggtcgtccaccaggtactcatgcaggttgatgttgtcgtcgaggtagtcgtcggccggcgatgggaagccggcgcggacgggggctaagaccaacggcagaggctggcctccaggtatcggcatcaagtaggggatggtggccatggtggtgaaattttgaattcgtacaaattcaaattacaccacaggtgaggaaatatcaaaacggatttcagtatgctttcggcaagggtgtcgcctcctgccacagtcgcgtccactcaactgcgtatttgtcggctagcggcttgacgttgcgtagcagcagcacgttttcggcgttcttgctggctgcggccgcgctgtagttgaacgaccccgtttccaggtgctggccatcgatcaccatgaacttgtggtggaagatggagtaattgccattcaggcgcaccggcaccccctgattcgccaggaactgcgcagcgctgtagcccttgcggttgctcttctcgtcggcgacgacttgcaccttcacgccgcgcttgtgtgcgctcagcagcgactcggcgatcggcttgctggtaaatgagtaggcggcgaccagaatcgacgactttgcgccgtcgataccctgcaggacgagcgcgaggctgccgcctttgggcgagaacccgacttcgaagtcggcgccggctggtaggggtgcagcaaaagagaacggcgctacaagagcgccggcgaagagtagggcggagagtttcatcagttgggcctgtgtagttggtagccatgctgtcgccggcggcggtcaatgtccttgagccgcgccgtgctgaatggttccgtcgccatgccgccgcgccggctcccgcgtccgccccaggcgcgcacgatcaccggcctgtcgaacaggtccagctggatggcgatagcgtagtagcggtcggcggagaggtagaggcgcatggctgattgctccttgatttgcaatcagcatggcaatgatgcgtgaattacgcaaatttacagagaatgatgcgcgaattgtgtgtcaattgggcgacggcgcagcggcgagcatgcgcccccacacctcgcgcttcgcccattcctcatggatgtttatttctccagcgccagaccagtaggacttgcggatcatttcctcggtcggtttgatcgggacaagcctccatccatccggcacagcctgaacctgtaaggattccttaccaattgccttttcattaggcagattggcatcggcctcaagccagtaggtcttcgcccaaagctcactgccgatgggatattcctcgccagcgatgccgcgcatgattaaatcgtcagggcggagcggagtgattccttctcgcgtgccgacatgcttttcaccctcccgctgcttgcgcacatgaacaaccactgggcgcttcacgcaggcgcgccactccaggcccaaacgggaagcggctgcgctttccgcagcggcagcggccgccagcgtggcctggcacagccgacgcatggccacccagtcgctgtcggttaacgaccagcccatgctgtctatgattgcgtcgatgtcgatcattggtttctccgtttcggtgagcaattgctcatctgagaaaatgggtaaatgagcagatgagcaaaggggcatgtgagcatttacccctcgttgtaacggcgcagcggcggcaggccgcgctcggcaagcacgcggttgaagccttccacgcccaggtcctgcaggctcgacggccgttccgccttggcgaggtcggaaagccggcggtggtcgtcggggtggacctttaccttgatggacacaaagtccggcagaggcttctcttccttggtcggtgcttccgcctcgccgccgtccaggaatgctttcaggctggtcttgctcattgcagcttctccttgacccattgccacagggcccggatctcggccgccgccttgccgcgcgggtcaaactccgtcaccgactggccggtggcgatggcgcgtgaaaatgcgatgcgctcgccgatctccaccggcgccacctcgccgaagtcggccagcgcctggcgcgcgtcggcgacctccggcacccgagaagggcaggcggacagcacgaacagcggctccttgcccgcggcggtgacgatcttcactgcgttgccgaccgcggccaggtcgaatgctgtcggccgaacggggatcaggatgaggtcggcgacccgcgcaatggcagctgaatcgggagaggagtgtggcggcccgtcgatgatggccaggccgaatcccttggcgctgccggccttgagcgcggcttgcagctgcgagggcggcgtttggagaacgaccggggattcggcagagcggctgccggcccagcgcgagctggatgcctgagcgtcgtctcggtcgaagatgattacggaggtggagtcctcttcggcggcgacgccaaggtggacagcaagggtggacttacccgagccgcctttttgcgagaatgtggcgatggttttcatgtttcctctgggcatgaaaaaacccgccggcggcgggtttgtggtggcgggaagctgggcggtacaaatcgcccaaatttcgcccaaattttgaaaagttgccctgtaagccaatactggcttgtttggggtgcgggttcgattcccgccgcctccaccacattcaaaacccaaccgttcgcggttgggtttttctattgtccgcgtctattgccgctgtgccgcggcagggaaaattcctatacacacaaaatgcgaattggaatggatatattgtgtgtattcaattgtttggcgatcgactcgctgcagggctttgaaagcgcttcgcgcggggcagaagaaaaccgggcgcacgcgcccggttggtcggcatgacttattgcggcaggttgtcgttgctggccagctccagctgcgcctttttcacccgcttgtcggcggccagcctttgctgcaggcccaagagttcggtctgggccggcgcttcgtataccaccacgctttgggtgcggaagcgcacgctcaggccgtggtcgcgggcgacggcggcttcatcctgggcagaggccagttgcaccagcaccgtgccgctgacggtggcgggcagcgcctgcttgggcgactggaccacgtcgccgcggttcaaggccggagcgccgctggcgcgaaaactggcgccgctggccgatttggccgctgccttggcttggcttgcttgcttgtaataggttttgccgttgatggtgacggcctgtcccgccggcttgggcaggaagggcaggtcggccgccagcgcgccgccggccagcgccagcagcgagagggtcaggatggtttttttcatgttgcgctcctgtggccgaagaagcggatcgaccacgatttcagtttgcccgccgcattgggcagggtgtaagtggtgttcttggcgccgacgcggtggatgaactggtagtcgccgccgttggtgtctatcacgcggatgcgccattggcccttggccgattcgccgtagaaatggttggacagcaggcgctgctgattgagaccgtagtcttccgccaccagcgcggtgcgcggcgatagcagcaccgagcgggtgccggccggcgaaatcagctccaccgccaggtcgctggcgcggctgtgctcggcatccaccaggatttgcaccgcctccaccgtgagattgtccggctgggtgtagacgctttccacgcctttttcgtcggcgtcgggaatggatgcctgcgcgctgatggtctgccagcgggttttttccagcggcggcagcgggcggttatagaacagcgctttttccaccgctttgtcgacgttgatcaggccgaagccgtaaaactggtggaagggcaggccagcggcgtttttctgccaaccgggaatcgcctggtagcggtggctgccgccgccggcgtcctggaaggccagcgcgacgccggggttggccgcatccacctggcgggcggtggtgatcaggatgtggcgcacgtcgcgggcgttgagggccggattggccgacatcaccagcgcgaaggcgccggaggtggccggggccgccgacgaggtgccgttcatcacgccgttgtagtcgcagttggggtccagcgcgttgccgccgtgcagcgcgttgtcgctgctgccggcgatattccagccgcgctggcaaccggtcaggtcggtggtgatcatggctggcgagtcggtgccgtattcgccgccgggcgcggtcagcagcacgttggcgcccaccgacgagtacgaggagcgcacgccgtcggcgttcagcgccgataccaccacgttccagtagttgctgttgtcggtggtgaggttggcgtcctgcaccggcaggccttcattgcccttgtagcctatcaggtagccgttgccggcccggaagtagctgtaggcgttgccggccgatttgacgaaggtcgcgccgcggccccagtggctgttgcggctgacgtcttcgtaggtttcctcctcggttttcagttcgatgtcctggtcgggattgcccggggtggagcggacggcggaggagccgtagctctggttgaacacgcgtgaatcggtgaaggcctccagtggccgtccgcccggttgtttgccgtgcgacagcagccagccgtccagcgtttgcgccagcaaccagttgaagcctttcaggctggcggacggcgccacgccgcgtccgcctatgccgttgaatcccaccgccgccgctatgccggccaccgaggtgccatgggcgttgtcgggcgagtcgggagtggggtcgttgctgccgttcaccaggtttttggagcccggcacgatgttggcggccaggtccgggtggcggatttccaggccgtcgtcgatgacggcgatggtggtgccgactccgcggatgccgcgcaagtgagtgaaggccagattgagatcgacgcccttgacgccgccgcgtttggaaaacgcgttttggccggtattctgcaagtgccattgttgcgcggctagcgggtcgcccggctgcaacggagtgttgcgcggttgttcggcggcggcatggctggacagcgatgcgagcgccagcagaaccgcgctgcttgagatgcgatggtgcatggttttatcctctgatttcctttgttttgttcggcgtagccgaatcaagatattatttgcaaatttttattgcgcaaatacccttttgtcataatgtttgcgcgatggagaatttgcaggatggcagaggacgctcggaggaggagggcgggcggggaagggcgccggctccatcgcggagccggccgggggtcaatctatcttggacagagtatcgaagttgctgtggcagcaatcctcgaattcctgctgcgggtctttcagtttgatctggtacgattttccctgcgcggtgaggaccagttccttgtcggccgaggtcagggctcggggcatcaggaaccagcgctgtcctttgcgggaattgggctgggtgatgtagatggcggtgaagggcgggatatcctggcgcgaggggtcctgcagcgagacgcctaccggcgtctggcccaggatttctatcccgaccttggtgccgttgttctggcgcaggatgcggcggatcacgcccagcagcagcgggtggctctctgttttcaccaggatcagccggcctatggccagctggtctatggttttgccgatgaaagtcagccccatgccggtgctgctgatatcattgatccgccattcgtccacccgctcggggtccagcgatccgacatcctgcaccttgatctggaacgccacccggtcgaagccgatggacacttgcgcattggaggtgtgcagcgagcgttccgacttgcgcagcgacttgccgccgtcgttggaccagcgtatcgccagcttttcgcacaggtcggcccactcctcgcgttccagctcgcagcccagcgtggcgagggacgaaggtatgcggctgtccaggtcgaacatcaggtcggccaggcggctggtgatttcataggctgaccagtagcggtgccacttgccggccatgccgcgcagcatcggctgcggcggctcggggatggacaggttgtagacgaagatcgggccttccggcggcgcctgcttgtccagcgggatgtgctggctcagcagcatcagcagctggtccaccgcgatgatttccttgtgcagcatgttctcggtctgcgccaggtgcagcatgccgatctggatcagcaggtgctcgcagctgatttcctggcgcgcgtccgggtatagcagcatcgcggtgcgggaaaatcccgcctcttcggcgtaggtgtaaaagcggaagccctgttgccaggcggtgccttccggcttcaggtagcgcagcgcgttccaggcgatcagccgcatctggtgatgcaagccgcggatggtgaccagctgcaggtcgggctcggccgccgggctggcggcgttcttgctcaagcgcaggcagatctggtaggcgctggacagttcgtgccagtaagccaggatggtgggaagatagcccttgctgccgcttttcgactgcagatagtcctggcataactggcgatggatgcctgcggccttgtcgtcgacatagagcagggttttcaccctctctttcagcgacatgtcggtgtcggcgttgattttggaaactgccttgatgatttccaccagggcggtaaagtattcggcctgcggcaggtcgcgcaccagaagggtggccgactgcgccacgccagatgccggcgtgtttttgctgaggagcgagctgactagggatttgaagtcaaacattgagccaacttttaatgggtttatgttctcgtttatatgtcactatatcttacgtcacgcgttgatgatggtgaaaccataatctcaaaattatcagacatgccaattcgcaagctatttacatttcgtctgtttattccggtattgtccttttcagtcctttttaatgcgccgccggcatatgccgccgacgaatcgcaagtgcctgagggcgttggcgttgtgctgggcggcggcggcgcgcgcggcttcgcccacctgggcgttctcaaggaattggagcgcctgcgcattccgatcgcctgcatttcgggcaccagcgcgggggcgctgattggtggcatttacgccaacggcctgccgctggatgagatcgaacgcgaattcaatgccgccgattgggaccagatgctgtccggcaagccggcgcgggcggatattccgtatgaccgcaagcgcaatgattacaaaaactatctcgatgtcagcttcggcctgaaggacggcgcgctgcgggtgccgcgcagcgccatcaactcgcaaggcatcgagctttacatccacaagctgacccgcgaccgcgacatcgacgatttcgacaagctgcccattccgttccgggcgatcgccgccgatttgagcaccggcgacgcggtggtgttcaagcagggctcgttgacgcgcgcgctgcgcgccagcatggcggtgccgggggtgttcgatctggtggaggacgaggggcggctgctggtggacggcgccatcgcccgcaatgtgccggtggaggatgtgaagggacgctgcgccaagcaggccatcgtggtggatgtcggcacgccgctgatgaagccggatgaaatccagaccctgttcgacgtggtggcgcaaagctccaatctggcggtgctgcgcaatgtccaggagcagatgaagctgctggacaagaaagacatcgtgatccggccggacctgaccggctatgccgccacttccttcggcgatcaccaggccatcgtgcggcgcggcgaggaggcggcgcgcaagatggccaagcagctgtcggcttactcggtgtcggaggaggcctacgccgcctggaagcgcaagctgcagcggccgcgctatccggtgctggacgaagtgaaggtggaggggacggacggcaccttcaccaagctttccacgctgcgcgaatcgctggcctttccggggcctgtgccggtgggaacggcgcgcaaccgcttggctgaaatcttcaccggcggcgaatacgacaagctgggctaccgcgtcgacaatgtgtccggccgcagcgtgatgacggtgatgccggtggagcgcagcatagggcaaaactatctgcatttcgggctgaacctgcgcagcgataccccgggcgacaacagcttcacgctgcgcgccgcccatgaatggacggccttgaacgacgccggcgcgtcctggcgcaacgacttggcgataggctacgacaagtcgatcaccaccgagctgtaccagccactgtggaacggcagcccgttcttcgtcgccggctcgctgggttatgagcaaaagccgttccgcgtgttcaatgacaaccatacggtgctggccaccttgaagaacgatgtgctgagcggccaggtgaatgtcggcctggctctgggcaagtacggcgaatggcgggtgggcctgtaccggcaggacaacgattactcgctggagcagggcgaccccagcgaattcaacggcaacgatcgtttccgcaacaccggggtgcaaagcagcctggtggtggaccaattcgacaatccgcgctggccgagggccggttattacttcagcggcaaggtcggcgccggtttgccggggctgggcagcgaggtcaaccagaaattctatgacctgatcggcgagacggcccacacctatggcgacgtcaccgcgcgcttcaccgccaaggccaggggttatgtggatatccgcaatggcgacattccgcagacgctgggcggtttcctcaatctgaccggttaccagaacggcgagttgctggccgatcaggtggcgttggcgcggctgatggtgtattggcgcgccgcgtcgctgccggcggtgctgggctccggcgtatacgccggggtgtcgctggaggccggccggctgtgggggcagaactattccgacctccaaaccgcccgcggctggattcccgccggttcgcttttcctgggagccgacaccattctggggccgttcttcgtcggcgtcggcacggcgcgcggcggccagttgaccggttacatctacctgggcgtcgattactgatcttgatccaaaagaacgcccggcgatgagcggtcatcgccgggcgttgtcgtttgcggcgccggcagcgcatccgggcaatgaaaaccgcccgcgggcgaggcctgcgggcggtttgacgtgccgcgggatcggcttagaagaagcggtagtccaccgtcacgccaaccgtgcgcggcgcgccgaccacgcccaggttgttgccgcgggatgcgatctgggcatacagcacgccgcggttggtcaggttgttgacgtaggcgcgcacgccccagcgggcatcctcgtaaccggtgttcaggttgaccactgtgtagtcgccggccttcagactggggtcgttggtgatctccgagtaataggagccgacgcggttcaggctgccgcccacgtagaaattgcgcggcaggcgctgcttgaagcccaggttgacggtcatgtgcggcgcgtagttgaactggttgcccatgatgccggggttggcggcatcggtgccggtcaccttggtgttgagcaggccgagaccggcgttgacggtcagcgtcggcgtcaccctggccttggtttccaattccaggccgtagctctggccttccggaatgttggtgaagcgcgaagccaggatggcctggtagccggtgtactggttgaagaaggcgttggcgttgaggctgacgcggttatccaggaaagcggagcggctgctcaactcataggcggtgacttcttccttgttgtaggtgtagtagacgtaattgttgtccaggccggagccgccggcgttgtagcccttgcgcgcggtgaggcccagcgtggtgtccggactgtagcggtagctcaggccggccttgggcaggaacaaggtttcgcccacgttgtagctggcctggttttgcgcggcggtatccggattgaacagggtgtggcggcgctgcatttcgcgctcgacgcggccgcccagattcaggctccacttatcgctgagcgccaaggtggcctccccataaagcgcttcggtcttgaggcggtccttggccagcagattggggaactggaaggtgcgcaggctttggtcgcggtcgtagtggtatacgcccatcatcccgctcagccagccgttttgcggcgcataggcgagtcgggcttcgacggtgtcgcttttctcatccaggcgcatgttcagcggcggggtgtcggtgtccttgaacgcgctgacgttgtcggcgtgcccgaccagcaggtgggcgctccaggcgtcgttgaactggtattgcaggtcggtgctgatggtgttgttggacgagtcctgatagcgggcctgggtggacaggcgatggtactggtagtcgaagtaattgccgtcgacgtagttcaggtagtcgcccttgtccttgcgatgcgataccgtcagcttggcgctgaagccgggcagggcgctgggtttccacagcagcttgccgcggtagctgctgtgattgatgtccgagccgtcccagggcatctggcccggatagtcgatgtagctgtggccgttcaggccctcggcggtgacgcggaaggccagctcgtcggtgatcgggccggagaccatgccggccagcgtcgcccggccgcctttgtcttcgtagccggcgcgcaatgcgccttcccaatcggaagccgggtccttggtgttgaccacgatggagccggccatggtgttgcggccctgggtggtggactgcgggccgcgcagcacttcgatctgttccacatcccacgggctggcgtcgacgtagcgctggccggtccagctttccgccatgccgtccaccgtggtgctcacccgcgggcgagagccggaaaccagcgtgttgtagccggtgccggggccggtgccttccacgccgcggatgttgacgatgccggcgccgtttaggctggcgttgggcgtggcggccgccgcgtcataaaccgatttgacttcgcccttgtcggcgtcgcgcagcactgtcaccgcggtggtggtgtcctgcagcgagcgattgatcttctcgccggtgacggtgaccgcgggcagagtggtggaattgtcctgcaggtcgggcgcgccggccgccagggcggcggtgcttcccaggcaggccagcgccagaatggtggcctgcgatagtgccttgcgttggcggtgcggagtgtttttcatcttgcttgcgttcctcattgttgtcgttgccagagcgtccgggtgttctgcgtcgtctggctggcgaggaatcgttggctattgcggcgtctgaacaagtcgggatgatgctggcccgggacggagcattgcagctcgtcgatgcgaatgataatatttatcattaataatatgcaaacggtaatggcgcgccgggagaaatgcgcgatccgactgccggagtggattgaaatcatgggtggaaatgtgaaatggaatcaaatggctgccgagagtgcggcctggctgcaacacccggacgcgggcctgccatcctggtgggaacgtctggctgtcatcggcgcgccgctgcgcgagcggttgccggacgggcgcgtctgcgtgactttcctgtggcgcgatccggccggcggcccggccgcgtcggcgacggtgcgggtgtacgccgatgtcaattccgtcaccgaccaccatagcccgcagccgcagtcgctgtcccgcctgggcgataccgatgtctggtggtggcaggcggtgttgccggcggattggcgcggcagctatgcctatatcccggtagcggccggacagacgccgccggttcccagcgacgatgtccgtgaaagccggctgcgccaccgcgaatggtggctaagcatcatgagccaggccatcgcggatccgctcaaccccgccgccggctaccgcagcagctggggcgccagcttgtcgccgctgcatctgcccgacgcgccggaccagtccgcctggaccgcctgggacaaaaccgggcagggggccgatccgcaccgcctgacggagatccgctgggacagcgccatgctcggcaaggcgcgccgggtctggatctaccacacaggcgcggtttctgttggagaatgggccgggaggccgctggcgatcctgctggacggccagcattgggcgcagcgcctgccggtgttcgccgcgctggacgaggatacccgccgcggccgtttgccgcccgcggtgtatttgctgatcgacagcatcgacggcaagcaccgcgaggaagacctgccctgcaacgccgcattctggctggcgctgcaagcggagctgctgccgcaggcggccttgatcgcgccgttcagcgaccgcgcagaccgcaccgtggtggccggccagagttatggcggcctggcggcgatgttcgccggcctcaactggccggaccgtttcggctgcgtgctcagccagtccggttcgttctggtggccgcatgtcgagctgcatgaaaaggcgcgcgcggcgagcggccgcctgccgggcagcaagggctggctggccgagcagctggaagctggcgagacgccgcccggacggctgcgcgtgttccaggaggtgggccgccgcgaggaggtgatggtggacgtcaacgatagccaccgcgcggcgctggagcgcgccgggcatgacgtgcattaccaagtgttcgaaggcgggcacgactggctgtgctggcgcggcggtttgttgcaggggctgggctgtctgtggcggccctgggtcgccccgtaaaacaaaccagaatcgtccaaaggcgggccaagcccgcctgcaggccggctcgccttgctggagtgttcgccatgagcgcggagcaaaccaaccctttcgatgacgaaagcctttcctttcttgtcctggtaaatccccaggaccagcacagcctgtggccgtcgcaactcgcgtcgcccgcgggctggcgcgccgtattcggcccggccggccgcggcgcgtgcgtttcctatctcgacgccaactggaccgacatccgtccgcgatcgctgcgcagcggttaaggccgccgtttcctcatcttcgcatcgtcccgcccatgccgcaggcctgggcgcggccggctgcgcgccggccgttccgattacccgcatccggggaagcatcgtgttgaccattgaaaccaaaccctccgccgtagagcgcgagctgccgctgttcggctcgcaactgggcatctggctagcggaccagatcgccgaacaaaagaacacctacaccgtcgcccactgcgtagcgctggacggcgcgatagacgccgagcggttgcggcagtccatccgtttgggcctggccgaggccgacactgtcgtcgcccagtatctggaaacgccggaaggcccggcgcagcgtctgcggcaagggctgagcgccaaggatctgccccttcccgaaatccatgacctgagcgccgaggccgatccggaaagcttggcccgcgaatggatgcgagccgacctggctgccgagctggcggccgacggcgagcggccgttgcatctgcaccgcctgttcaagctggccggcggcgcgggcgagcgctggttctggtatcagcgctaccaccatgtctgcgtcgacggctacagcttcgccgcgctgacccgccgcatcgccgacctctaccaggcgctgggccgcggcgaagcgccgtcgccgtcgccatttgtttctttcgtcgatgtcgcggccgagcgcgacagctatctggccagcccgcgctgcgaggaagaccgcgcgttctggcgcgactacgccgccgcgctacctgcgccgtccaccttgtccgcgcgcgacgcgctggccggagacggcgcggccaatgtcgacgtgctgcgccgacggtttgaaatcgccggaggaacggcggcgccgcaggccatggcggccgttttcgcctacctggccaggatgagcggcaagagcagggtggcgatgggcatgcccttcatgcggcgcatgggttcggccgcgctgcgggccgtgggcccggtggtcaacgtgctgccggtggcgctggatatcgacaatggcgacgatctggctacgctcgcgcggcggctggccgacgaattgaaacaggtgcgccgccatgagcgctacgatgccgagcagatccagcgcgacagtggcatggtgggctcccgccgcgcgctatacggcgcgacgctgaacctgaagatctacgatcagtcgctgcggctgggcgaggtggcgggcgtcacgctgccgctggcggtggggccgatagacgatatcgaattcggcctttggcagcagggcgagagcctggtggtggagctgagcgccaatccggcgcgctacggcgcggcggagctggagtggcatgcgtggcggctgcgcggcttcatcgccgccctggccagcggcgcggccgtaggcgacgcgcccttgcacagcgccgcggagaaggccgcgcttgacgagtggtcgcgtgggccgcgggtagccgcgccggccggcgtgcgcaccgcgctggacgtattcctggtcagcgccttgcaataccaaaatgagaccgcgctggcgtgcggcgacgagcggctgagctatggccagctgtcggcccgcgtcgcgcagctggcgcgcgagctgctggcgcgcggcatcggcgacggcagtgtggtcggcgtcgccgtgccgcgcagcgtcgacaccgtggtggcgatactgggcaccttggcggccggcgccgccttcctgccgctggacctggactacccgcccgagcggctggcgatgatgtgcgaggacgccgcgccggcgctgctgctgacccgctccgacgtccgcggccggctgccaagcctgccggcgttgtgcctggacgacgaggcggtccgcgcgcgcttggccgcccgcgccgcccagccgctggacgacggggaacggctgcgtccgctgaacggcgaccggctggcctatatgatctacacctccggctccaccggcaaaccgaagggcgtgatgatcgcccatgccagcttcctcaacttgctgctgagtcagcagaccggcttgttcggcgacttcgtccgttcccgcggtcgccgcgtgcgtacgatgcagaccgcctcgctgtccttcgacggcgcgctggagcagctgttctggctcttcatgggccaagaagtgcatctgtgcgacgaagaactgcgccgcgacgcgcagcagctggtggagctggtgcgccgcgagcgcatagacgagatggacgtgccgccgtcgctgctgcggcagatgctggactgcggcctgatggacgacggccattggcagcccggcatggtgatggtcggcggcgaagcggtgccgccggcgctgtggaaggaaatgcgcggctactcgcagctgcatttccataatttctatggcccgaccgaatacacgatctcggcgctgggcgcaccgggctcggtcgcggaggagccggtggtgggccggccggtggccaatacccgcgcgctggtgctggacgccgcgctgcgtccggtggcgataggcgtggccggcgagctgtacctggccggcgccgggctgggcctcggctatctgaaccgcccgtccttgaccgcggcccgctttgtcgccagccccttcggcgacggcgagttgatgtaccgcaccggcgatctggtgcgttggaacgcccacggccagatggacttcatcggccgcgtcgaccaccagatcaaggtgcgcggcttccgcatcgagatgggggaggtcgagcacgcgctggccagcctccccggcgtcaacgccgccgtggtgctggccgaggcggtgggcggcagccaccggctgatcgcctattgcacgatggccgacgccggccgccacgaggaggccggcctgtccgccgccttgctggcgcaagtggccgagacgctgccggactacatggtgccgtcggcgctggcggtgctgccggaatggccggtcaacatcaacggcaagatagaccgcaaggcgctgccggcgatccggccgcagaacgccgccgcaggacgggagccggccaacgacgccgagcgcctgctgtgcgcggcggtggcccgggtgctgaacctggagcaggccagccccgacgacgacttcttccagctgggcggcgacagcatctcggcgatgagcctgggcaccgagctgcgtcgcgccggcttcctgctgcgcccgcgcgacgtgttcgccaaacggacgccggccggcatggccgcggcgctgcagcccttgagcgccgccaatccggcggccgacgacaaggccggcccgctgggcaagctgcccatcgtcagctggttcgccgagcaatacggcatggccagccgcttcgtccagggcgtgtggctgaaagcgccggcagcgctgggcaccgaacacctggccgccggcctgttggccttgcagcgcgcccacccggccttgcgcagccgcgccgccgatggccaactgcatctggatgccgctccaacggcattggacgcgcgggtactgatcgaggccgcgccggaggcgacgccggatcagctattcgaaaccgcctgcgcgcggctggacccggaaaacggcctgatgctgcaggccgcgctgcgggacggggccgacggcaagcatctgttgctggccgttcaccacctggcggtcgacggcgtgtcttggcgcgcgttgctgcccgagctgcaggccgcctgcgaggcggcgatggccggagaggcggtccaactgccgcgcgaggacttcggcctgcgcgaatgggcgaaaacgctggcggcccaggttccggcgcgccgcggcgagctggcgatgtggcgcggcatgctggccggaaaagccgacgcattgagcgccaaggcgctggacccggcccgcgaccgccacgacgcggcccgccaccgccgcgcgctgctgggcgaggcggccagcgcggcgctgctgcaaaagctgccgaacgcctgccgcgcgacggtggaggaaatcctgctggcggcgctgctgctggcttgccgcggcgaattcgacgcgccgcgcttgcgcgtgggcctggagtcgcacggccgccatgccggcgacgacggcatcgatcttggtcgtacggtgggttggctgaccgccgaatacccggcgctgttcgacctgtcagtccagacggccggcgacgcggcggctctggcggcgctgcgcgcggtcaagcgcgtgatgcgggcgatcccggaccatggcctgggctacggcgtgctgcgttatctggacgacgagcacggcccggcgctgggcgcgctggaggcgcagaaccgcccggcgctgctgttcaactacctgggccgcttccaggccagcgacggcgaatggatgccgctggccgccggcggccgcttcgccgacgccttcgccgtcgacatcgatccggctttgccgctgcaatacgggctggaggccaatgtcttcgtcgacgagtccggcgccgcgccgcgggtggcggtcaactggacctgggccgacgcgctgtatggcgccgacgccatcgagcgcctggggcaaaggatggacagcgcgatcgccgcgctggcccagttggcggagcgtgatccgctggccgcggccgataccttggtggccgctgagacgctgggcgccggcggcgcgccgctgtccgacgcggagctggcggcgctctgcgcccgccatggcagcctggccgcggcgctgccggtgttgccgctgcagcagggcctgctgttccacgcccagctgggcgaggcggccggcaagtacaactccatcacccgcgtcactttcgcaggcccgctgggcagcgacaggctgcgcgcggcgctggcggcggtattgcgccgccatccgcagttggccgccggtttcgacagcgaagctcaggccgaaccgttgcaactgctgccgcttgcgctgccggaatggccgtggcgcgagctggagctggccgcctcggccgacgaggccgaggcgctgcaggcgctggagcgtgaggagctggaccgcgactttacggtcggcggccccggcgatggcccgctgctgcaggccacgctggcgcgccacggccaactgtccacgctgttcctgaccgcgcaccatctggttgtcgatggttggtccacgcccatcatgctgcgcgacctgctggccgcctacggcgacgggccggacacgctgccttcgatccgcgtcgactaccccagcgtggtccgcgcgctggccgcgcgcgacctgacgccggcacggcagctgtggctgcagacgctggacggcgtcaagcctacgctgctgttcggccagcagacggccgcgccggaagtgcgggaattcgagctggtgctgccgcaagcgctggaagacgcgctgaccgagcgctgccgcgaacgcggcctcaccctgaacaccgcgatgcagggcatgtggggcgcgctgctgtcggtgctgaccggccgcaacgacgtggtgttcggctcgccggtgtcgggccgtttcagcccggtggacggcgtggacgagcatatcggcctgttcagcaacaccattccggtgcgggtggcgctgcggccggacgcgccgctgtgggaacagctggccgacttgcaggcgcggcagatccgtctgctggagcatgacgggctgggccttgccgaaatccagcgcctggccggcgcgaccacgctgttcgacacgctgctggtggtcgagaactacccggatcaggacatgcagtcgcgcgactaccactgcgcgcgcatcgcctcgctgcgcaaccgcggccatacccactatccgctgacggtgctggcgctgccgggtgaccggctgcgcctgctgatcgagtaccgcaatctggtgaaagagccgcagcagctggccgagcggatgctggcgctgctggcgcatctggcctaccggcccgagctgccgtggtcggccttcgacccgttgaccggcgccgagcgcgagctgatcgacaaggtcaacgccaccgcagctgcgataccggaagccacgctgccggacttgctggccgagcaggccgccaggacacccgacgcgccggcgctgctggacgagacgcatgcgctcggctacgccgaaacccgcgctcaggtcggccatttggccggcaggctgaaggatgccggcgtcaagccgggcgacatcgtcgcggtggccttgccgcgctcggtgcacctgagcctggcgctgatggcggcgcaggaggccggcgccgcctatctgccgctggacaccggctacccggacgagaggctggcctatatggtggccgacgccaagccggcgctgatcatcacttgcgccgaactggcgccgcgcttcgcaggggtgggggaactgctgctgcaggacgcgctggcggccgagccgcaggccttcgacgcgccggcgctgacgccggatcacgccgcctatctgctgtacacctccggctccaccggccggcccaagggcgtgctggtttcgcaccgcgccatcgtcaaccgcctgctgtggatgcagcacgagtacggcctgggcgcggacgacgtggtgttgcagaagacgccttgcagctttgacgtgtcggtgtgggagtttttctggccgttgatcgtcggcgcgcggctgttcatggcgccgccggacgcgcaccgcgacccggaagcgctgctggagctgatcgccgggcgcggcgtcaccaccttgcactttgttccgtctatgctggcggcgctgctggcccacatgcagggcgacgccgcggcgcgctcggcccaagcggctggcttgcgtcgggtgttctgcagcggggaggcgctgtcgcgcgagctggccgacggctatgccggcctgatagacgcgccgctgcacaatctgtacggcccgaccgaagcggcggtggacgtcagttaccagccggtggccaagccggcgccggagtcggccagcgtgcccatcggcctgccggtgtggaacaccgcgctgcggatactggacgccgcgctgcggccggtgccggtcggcgcgccgggcgaactgtatctgtgcggcgtgcagctggcccatggctatctgggcaggccggacctgaccgcggcccgcttcgtcgccgacccgtacgccgatggcgaacggatgtaccgcaccggcgacatcgcgcgctggctgccggacggcaccgtcgagtatctgggccgcagcgacgaccagctgaagatacgcggtcagcgcatcgagctgggcgagatcgaggcggcgctgctctcgcagccgggcgtggcccgcgccgtggtccacgcctgcgcgctgggcggccaggcggcgcatgccgccggcgccgacaaccgccagctggtcggctatgtgatcgcgtccgatccggaccatccgcccgaggccgacgcgttgcgggcggcattggccaaggcgctgccggcgcacatggtgccggtggcggtgatgcggctggcggactttccgctcagcgccaacggcaagctggaccgcaaggcgctgccggagccgtcggctgcggcgtcgacagaaggccgcgagccgcggccgggcctggagagccgcatcgccgcgctgttcgccgaggttctggagtgcgacgctgtgttcgccgatgacgatttcttcgcgctgggcggccactcgctgctggcgatgcggctggcggccgcgctgcgccgcgagctgaagctgccggtctcggtcggccagatcatgagctcgccgacagtggccaagctggcggcggtgctgtctgacgccggcctggcatccgacccggcgctggccggcttcggcgaggtgctgccgctgcgcgccggcaaggggcggccgctgttctgcatccacccggcctccggcttcgcttggcagtacagcggcctgtcgcgccatctgcgccccggcctcgcgctggtgggcctgcagtcgccgcgcccggacggcgccatcgcccgcagcgtcgacatggacgaggcgtgcgaacgccatctggccaatctgcgccgcatccagccgcaaggcccgtatcacctgatcggctattcgctgggcggcacggtggcgcaggccatggcggccaggctgcggcagcagggcgaggaggtggccttcctgggcctgctcgacacttatccgccggagggccaggactggaacggcccgaccgaggaagaggccaaagccgaagtggcccgcgagcaggagcagttcatgtccgccaccgaggatgccgccgacgccttcatgctgcgcgagaagaccgagatgttcggccacatcgtcgccaactatcaggacgcggtgcggctgttgtcgcaggcgcgcacgccacgctacgacggcgaggccacgctgttcgtcgcccgccgcaccctgccggaaggcatggacgtgcgcgagacctggcggccgcatctggccggcctgaccgtgcacgagctcgattgcgcgcacgaggacatcgtgtcgccgcagtcgctggagacgctcgggccgttgctggacggcatgttgaaggaggtggacagcctggggtgatggtgcgttttgcctcgtgctggataggcaaggcgcattgaggacgcggaaatgccgcgcttggtaatcaggcgcggcattttttttgcaatgggatgtttgctcaaggtctttgccgggtcactgctgttttctgtggaatgccggttaggaaaagaccttgcataaacggctaggccatgtttgaacggtcggagtcacagacatctgttccagacgtccctgatcttgtgagtcgggtggtgattggcttggtgagaaccggccgcgtcccgcatcttgaaccgcaagcgaaggagactcagatgaaaatcttgatcgtagtgggagagggggtggcgaacagctctggggtctcggttttggaccagtccctggagttttacgggtatgggcttgagctggtgaaaaaataccttcgtttcagcgaagaggactcaagaggcgtgggggtggcgttttatatccccggctccataagccagcagcactccgaatatctcaatatcatgagcgaggccatgaggacgtcggtcgtggatgtcgcgttcttctatgacagcatcgccggactgatggaagcactgatgaaggcgcgcaatgagcgtacctgcctgatcgtgatcggccacggttttcagattattggcgggggcgcggtgcaattgctgaatgggaagggggcgaatagcattgaagataaagacatcaatgctattcgcccggatgtatacatcggcctgcattgctatccgggagccatcctgaataagctgagcaatagctgcattgcttgtgggctgaccggactgaatgtcgggcaaaatggccatatcaagaatttttgcgagtctgacaagctggatcgattgtttgaggatgtttgtcaattgttttttatcgtcgacatagaaggcatggacaagccgacaatcaacgagcatgagaaggcggtgattcaggcgctgaaaggattcaaggatcattccacgcctgagttcgcggtgacggaaaccgcgtcgctggcgctgagcaagagctgaatgacgagccgagctgaatcgtatggaaccggcccgtcaccctattgtggctctcagcgcggaatcaccatcggcgtatggctgaccgggtcttcgatgatcaggcagggcaggccgaacacctgctcgatcaattcggcgctgacgatgcgcgacggcgcgccttcggcgacgatgcggccgtccttcattgcgatcaagtgggtggcgtagcggcaggcgtggttgatgtcgtgcagcaccgccaccaatgtgcggccgccgtcgcggttgagcgtgcggaacaactccagcagctcgatctggtgggcgatgtccaggtaggtggtgggttcgtccagcagcagcagcggcgtctgctgggccagcgccatcgccacccagacgcgctggcgctgtccgccggacaactcgtcgaccagccggccggccagctcggcggtgccggtggcttccagcgcctgctggacggcggtttcgtcgtcgcggctccattgccgcagcaggccctggtgcggataacggccgcgagccaccaggtcggccacggtgatgctgtccggcgcgacggcgctttgcggcaacaggcccagctggcgggccaccgccttggccggctggctgtggatgtcgcggccgtccagccgcacctggccatccagcggcttcaacaggcggctgaggctgcgcagcagcgtcgacttgccgcagccgttggggccgatgacgacggtgaaggagccatcgggtatccgcaggttcagccgctcgcagatcgtccgttggcggtaacccaggcgcaggccgtcgccggacagccgcggccggccggacgcgggcagggtggcgtcgagtgccgcggcggggttgagcttgaaggacagggtggtcacgatttcgcgcctccggtttggcgcagcagcagccatagcaagtaaaggccgccgatgcagatggtgacgacgccaaccggcagctggcgcgggtagaacagatgctgggcggcgtagtcggccgccagcagcagcagcgcgccggtccaggcggcggtcatcgggctggtggcgcgcgcgcgctgcaggcgctgggcgatctgcggcgcggccagcgcgatgaaggcgatggggccggcggccgcggtggcggaggcgatcagcgccacgcccaggcccatcagccacagccgggtgcgctcggccggcacgcccagcgcattggcgctgtcgtcgcccatttccagcagctgcatccgtggcttcagcgtcagcgccgccagcatcgccagcaggcagagcagcgccgacggcaagcccttgctccaggtcatgccgttcagcgtaccggcgccccagatggcggcgctcatcgccgactccaggctggcgttgatcagcagccagctgttgagcgcgctcagcatcgcgctgacggcgatgccgacgatgatcagccggaggccgtgcgcgccgcgccgccaggctagcagataaaccagcgcggcggaggcgaggccgccggccagcgcgccgccggcgatctggaaatggctgccgcctatggtggtgatcaccagcagcgcgccggtgtaagcgccggtgttgaaacccaccacatccgggctgcccaaggggttgcgcagcagcgattggaaaatggctccgctcatgcccagcgccgcgccgatgatcagcgccatcgccacccgcggcagccgccattgctgcaccacggccacgttcagccggctgccctggccttgcagcgccgcccacacttgctcgacgctcagatgcaaggcgcctgcgcgcaggctgatcagcgccagcgcggcgcaggccgccatcagcagcagcgccggccatagccggctaggccggaggcgaaggttgaagcggccgtctggatggcccagccgcaggtgcgctgttttcatggtttacctcccgcgccgccgtggctgcgcgccagccagatcagcgccggcgcgccgatgaaggcggtgacgatggacacgcgcagctcgcccggcgtcagcaagcggccggcgatgtccgaggccagcagcaagatgggggcgagcaggacggtgaagggcaggctccagcgcaggtcggcgccgcccagccggcgcgcgacgtggggaatcatcaggccgacgaagcctatcggcccggcgacggcggtgctggcgccggacagcagggtgacggcggccacggtaccgccctggatcagcagcggccggccgcccaggctgagcgctagatcgttgcccagacccatcgcgttcagcgggcgggccagcagcagcgccagcacgccgccggccaggatggcgggcgcggccaggccgacggcggccatgtcgcgcacgtccagggtgccggcgctccagtagcgcagccggttgaaggcgatggggtcgagcagggtgatggcggcggacaggcccatcagcaccgcgccgaccgctacgccggccagcacgatgcgcagcggatcggcgcggcggccgcgcgcgcccacggcgtagaccagcagcgtcgcgcacagcgcgcctgccgccgcgcaggccatgtagccgccctggctgtccacggcgaggaaggcgacgcccagcaccatcgcgaagctggcgccggcgttgacgccgaggatgccgggatcggccagcggattgcgggtcagcgcctggatcagcgcgccggacaagcccagcgccgcgccggccagcaggcccagcagcgtgcgcggtagccgcccctgcaatacgaccacgctgtccggcccggcggcgcggcccagcaagctgttccagacggtggcgagcggaatcggcttggcgcccagggccaggctcagcacggatacgacggccagcagcgccaggcaggccagcagcagggtggcgcggcgtccgcgggcgggacttgtctgcataatcaaatgaaaatgattcctaataacaactgccgatgttaccatgcctgttacatgaagggacaggcccatggcgcggcttgtcatcatccccgcggcgcgcatgccgctcttgatcgaaccactgcgttgagaacatgaaaaaatcgcccatcttcgtcgatttcagcctgctcaggcttaacccgcatttccgctccatcttcatcgcccggatgatctcggtgttcgccttcggcatcctgatggtggcggtgccggtgcagatccatcagctcaccggctccacgctgcaggtgggcgcggcgatggcgctggacggcatcggcatgttcgccggcctgatgtgcggcggcgtgctggccgaccgcatggaccgccgccgcttgatcctgctgggccggacttcttgcggcctgggcttcctggcgctggccctgaacggtttcatgaccaacccgtcggtgacggcgctgtatgtggtgtccacttgggacggcttcttcagcggcatcggcatcacctcgctgatggcgtccattccggtgatcgtcggccgcgagaacctgccggcagccggcgcgctgagcatgctgaccgtgcgcttcggcgcagtgctgtcgccgctcctgggcggggtgatcatcaccgccgccggcgtcaactggaactacctgctggccggcatcggcaccttggccacgctgattccgctgacgcggctgccgtcgctgaagccgcaaaacgccgaaccgtcgcacccgttgcgctccttgagggaaggctttgaattcctgtggcagaacaaggtggtcggcgcggtggtggcggtgggcacgctgcagacgctgctgagcgcggtgcgggtgttgtacccgtcgctcgccgaggatggctacggcggcggcgcgttcgaagtggggctgatgtattctgcggtgccgctgggcgcgatgctgggcgccttcaccagcggctgggttggcggcctcagccgtcccggcgcgatgatgctggcttgcgtgacggcctcgtcgctggccatcgcatccttgggcgctttcacccacctggcttacggcctggcggcgctggtagtgctgggttatctgggctccatcgcctcgctgctgcagttcacgctggtgcagggccagacgccggaccacctgctgggccgcgtcaacagcctgtggaacgcgcaggacgtggtgggcgacagcctgggcgcgctgggtctgggcgcgctggcgcgggccttggcgccgctgctggcggtggcctggttcggcgccggcgcggccgcggcgggtttgctgatgtgcgtgggctttggttccttgcgccgcctttccggcggcaagccggagcaggccgaaggcgagccggcggagcaggctgcggggtcttgagtgtgatgcgtggaatatgaaaaaaagcggacctcggtccgcttttttattgccgccgctcgggtggttttcagccgaactgcttgcgcagccgcgccagcagattgcgcgcgctgtagtagtccagccggaaggtgtccagcccggcggcgtacacctgcttggccttcaccgccggattgccggccaggaagggattggccagcacctgcggcacctggtcctggtcggcattgaacaggatcatcgatttgccttgcaggccgtcggcgaacttttcgccggtcagctggatgatgtcgtgccgcacgcccatgctggtattgcctttgacgctgtccggcgcggtggccagctcaaatcccagcgactgcagcagcttgccctgcgccgattgcggcgtccacagattggcgccggagccgtcctcgtaatagaccaacgctgccgtcggctgcggcggcagctttaacgctgccttcagctgggccgcttcggcgtcgaagccggcgatggcggcgcgggcatcggcctcgcggcccgtggcctggcccagcagcgccgccagttcctgccagctcttgtcgtcgtaattcaccaccagggtcggggccatctggctcaattgctcgtacagcttcagcgcggagtcgccgccggtgccggccatcacgatcaggtccggctgggcggcgatgatggcctcggcgttgggttcgccctgatacagcggcgtcacgccgcgttgcttggccaccgcgctccactgggtgaagaagccctgatcatccgtcaccttggaatgggcggcgctggcgccgctggcgaccaccggcgcgtggatggcgagcagggtgccggtcagcgtcacgctggtggagacgatgcgctgcggcatcttgtccagcgtcaccttgcccttgggcgtgtccagcgtgcgcggccagccggcggaggcggcggccgccttgtcggattcggcgggggcgttgcaagcgccgagcagcgcggcgaggccggctgcggcggccaggcgcagcgcgccgcggcgcgtggcgtaggggagcggcatggagtgtttcctttgcattcgatagcgtccggcgattttattgcaagtgataagtattatcattaacattgtcgccgatgccaaaattcccgtctcaaatccgggaatttgcctgcaagctcttgcgagcggcggatgggcgcgggcgctgcgcccggcttgtccgccgttcggtttctggactcgattgagcccgaagcgggagccgccaagtccaatcgccgaagaccgcatgcgtccgcgcgcgcattttccggggcttgatggttcccgttttcgcggccggaatgcacgggaatatgcggatattgacggttgttgcgatggcggcgggcttggccggctgcggagggaaggagccagcgccggaggcgggcaagccgcccgaggtgggcgtggtgaaactggaggccaaggatgtggcggtaagggctgaattggctggccgcaccgtcgcctaccgcagcgccgaggtccggccgcaggtcaacggcatcgtgctgaagcgccatttcaccgagggcagcctggtcaaggccggcgacctgctgtaccagatcgacccggccggctaccaggctgccttgcagcaggcggaggcgacgctggcgtccgcccgcgccgcgctgggcagcctgaaggggcgcgccgaacgctatgccgaattggccaagatagacggcgtcagccgccaggagcgcgaggaggcggacgcagactaccgcaagggcctggcggcggcgaagtccggcgaggcggcggtggcggcggccagggtggagctgtcccgcacccgcgtgctggcgccgatttccggccgcatcggccgctccgccgtcagcgagggcgcgctggtcacttcaggccagagcgcgactctggccaccatccagcagctggacccgatgtacgtggacatcgtccagtccagccaggatttgctggcattcaagcgccgtcaggccgacggcgagcttgagcccgccggctcggccgccaggctgacgctggaggacggcgtgccgtaccggcatcccggcaagctacgtttcaccgagttgaacgtggaccgcgtctccggcgcggtgacgctgcgcgccgaattccccaaccccgaggggctgctgctgcccggcatgtatgtgcgcgccgagctggagcagggcgtgcgccgccaggcggtattggcgccgcagcagggggtggcgcgcgacgacaagggccgagccaccgcgctggtgctgggcgccggcgacaaggtggagcagcggctgttgacgacggaaggcacccacggcgcttactggctggtgacgacgggtctgaaggccggcgaccggttgatcgtcgacggcctgcagcgcgcccgtccgggcgaggcggcgacgccggtggccttgccggccctggccgggaggagttgagcgatgctggcgcgtttcttcataggccgcccggttttcgcctgggtgctggccatcgtcatcatgttggccggcctgttcgccttgcgcgcgctgccggtgtcgcaatatccggacatcgccccgcccacggtgatggtcagcgccagctaccccggcgcgtccgcccaggtggtggagaccagcgtgatccaggtgctggagcaggagctgaagggcctggacaatctgatgtatttcagctctaccagctcctcgtccggccaggccgagatcatgctcaccttccgccagggcgccaacgccgacaccgctcaggtgcaggtgcagaacaaggtcagccagatgttggcgcggctgccgcagcaggtgcagcagaatggcttgtcggtgcagaagatgcagggcgacttcctgctgatcgcctccttttatgatgtcagcggcaagcgtagcgacaccgacatcgccgactggctggccagcaatgtgcaagacccgctgagccgggtggacggcgtcggctcggtgcgggcctttggcgcgccgtacgcgatgcgggtgtggctggacccgcacaagctgaacagctacggcctgattccgtccgatgtcagcgccgccatctccaagcagaacaccgaggtctcggtcggcgagctgggcgctttgccgtcgccgccgggccagcagctcaacgcgatggtcaccgcctggtcgcgcttgtccacgcctgagcagtttcgcgagatcgtgctcaaggcgctgccggacggcggcgcggtgcggctgggcgacgtggcgcgggtggagctggggcaggaggattacagcagcagctcgcggctgaacggccatccggcttccggcctggcggtgatgctggcgccgggctccaacgcgctggccaccgccgaggcggtgaaggcgcgcgtcgccgagctggagcgaaacttcccgccgggcatccgcgtcgcctatccggaggacaccacccacttcgtccggctgtcgatacgcgcggtgatggagacgctgctggaggcggtggcgctggtggtgctggtgatgtacgtctttttgcgcaactggcgcgcgacgctgattccggcgctgacggtgccggtggtgctgttgggcacgttcggcatgctgtcggcggccggcttcggcatcaacacgctgaccttgttcggcatagtgctggccatcggcctgttggtcgacgacgccatcgtggtggtggaaaacgtcgagcgggtgatgagcgaggaggggctggacgcgcgcgcggccaccatttgctcgatgagcgagatcggcggcgcgctagtcggcatcggcctggtgctgggggcggtgtttctgcctatggccttcttcggcggctcggtcggcgtcatctaccgccagttctccatcaccatcgtcgcggcgatggccttgtcggtgttgacggcgctgaccttgacgccggcgctgtgcgcgacgctgcttcggccgcatgcgccgtccgaacgcggcccgctggcggcgttcgagcgccgcttcaatcatttgcagtccgcctacgccggccgctggctgccaagctggctgcgccgtcccatgcgcggcggcatggtttatctggcgctggcggctggcctggcggcgctgtatccgcggctgccgacggccttcatcccggacgaggaccagggcacggtgatggtgcagttcacgctgcccaccggggccactcacgagcgcgccgacaaggtggcgcgcgcagtggagcagcatttcctggagaccgagaaggccaatgtcgagtcggtgtacatgttgtccggcttcagcttcggcggctccggtcagaacgccggcatggccttcgtcgcgctgaaggactggtcgcagcggcgcggccgggagagcagcgcccaggcgatagccgaccgcgccaccaccgcgctggcctcagcgcgggacgccgaggtgttcggcatggtgctgccgcccatcgggggcctgggtcagaccaatggtttcgagttctggctgcaggacgcgtccggcatggggcgcgagggcctggccaaagcgcgcgaccaattgctgaaggccgcgcagggcgacgacaggctcagcgcggtgcgctccggcgcagccgacgacaagccgcagctgcggctggatgtggaccagagcaaggccgccgcgctggggctggacccggccaatgtcgccgacacgctgggcgccgcctggggcgggcgctacatcaatgatttcatcgatagaggccgggtgaagaaggtgatgatgcaggccgacgcgccgtatcgttccaagcccgaagatctaggcctgtggttcgtccgcggcgcggacggcacgatgacgccgttttccgccttcgcccgcgcgcgttgggaatacggcccggcacagctgaaccgctacaacggtttgccggcgctgccgctgtcgggctcggccgccgccggcgtcagctccggcgaggcgatgaaggcggtggaggccgtggccggcaagctgccgggcacgcagtacgagtggagcggcctgtcttatcaggatcggttgtccagcggccagacgccgctgctgtacgcggtgtcgatattgttcgtcttcctgtgcctggcggcgctgtacgaaagctggctggtgccctgcgccgccatgacggcgattccgctgggcgtgctgggcgcggtgctggcggtgatggcgcgcggcctggccaacgacatctatttccaggtgggtctgctgacgacgataggcctgtcggccaagaacgccatcctgatcatcgagttcgccgaggcggcgatacggcgcggcgacgatgcgctgagcgcggcgctggccgccgcccgccagcgcctgcggcctatcctgatgacctcgctggccttcggcgtcggcgtcgcgccgctggtctgggccggcgggccgggcgccggcagccagaacgcgatcggcgcggcggtgctgggcggcgtggtatccgccacgctgctgacgctgttcttcgtgccgctggcgcatctgctgatacgcggcctggcggggcaagtcgcgcagcggcgtttgaaaatggcggaggcgcgcggatgaaaccaatccccattttgctggtttgcgtaggcctggccgcttgcgccgcgccgcagccggattaccaacggcccgccgcgccggtgccggcgcattggccggcggcgggcgcggagggcgcggagggcgcggagggcggacaggccgatgtggcctggcggcgcttcttcgtcgacgagggcctgcgcgcaaccatcgcccaggcgctggcgaataaccgcgatttgcgcgcagcggtcgccaatgtgcaggcggcgcgggcgcagtatcgggtgcaggacgcggcgcggctgccgaccgtgcagctgcagggcaacgccaaccgccagctcactcgcggcggcgatccgtcgctggcggctgacagccgcggtgtcagcgccggagtgggtgtcagcgcgttcgagctggatttgtttggccgcgtgaaaagcctgagcgatgcgcagtggcggcgttacctggccagcgagtccggcgcgcaggcggcgcgggtcagcctgatcgcggaaaccgccaatgcttatttgaccttggccgccgaccgcagccagctggctgcggcgcgggcgacgcagcaaagcgccgagcgctcgctcgctctgacgcgcgagcggctgcgcctgggcgcggcttcggcgctggacgtcagcgcgatgaataccgtggcgcaacaggcgcgggccgatgtcgcccgttaccaagggctagcggagcgggacaggctggcgttgcaattgctggtcggcgcggagcttggcgaggcgaggctgccggcggcgctggaggacaagccttacacgctggcggcgctgccggtggacgcgccggccgatgccttgctgcgccgaccggacgtccgccaggcggaaaatctgctgcgggccgcccatgcggatgtagacgccgcgcgggccggcttgtggcccaagctggggcttagcgccagctcaggattcagcggcgtgacgctggccggtctgctgaacgcgcctgcgcgggccttgagcctggcgctggatgccagcctgccattattggatggcggcgcggccagggccggcgcggatcaggcggaagcgcagcggctggcggcgctggccgcttacgagaaagccctgcaaagcgggtttcgcgaagtggccgacgccttgagccagcgccaggcgctggccgaggaaaaacaggcgcggcaggcgacgctcgccagcgcggaaacctcgttgcggctggcggaagcgcgttatcggcaggggctggacggctatctgagcctgctggaggcgcagcggatggcgcaggcggcgcgccagcagtggatcggcgccagcctggccgaggcggagaacatggcggcgctgtaccaggcgctgggcggggggctggatggctagcgcggccagtcgtccggccagtcggagctggcatagtggccagttgtttgctttttgttggacaaacgtttgaaccattgctggattttgcatttgtcatggcctatctcgatataggcgccattcggcgcctgaaatcatacgaataattcgggagagaaaatgaaacacctgttgtcgcgcagcgcattcgtcctcgccttgctcatgttgccgttcgcatcggccttcgcttcctccggctacacccaaacccgctatcccatcgtgctggtgcatggcctgttcggctttggccagatgctgggggtggattatttctaccaggtgccggccgcgttgaaggctgacggcgcccaggtatacgtggccgaggtttccgccaccgacagcaacgaggcccgcggcgagcaattgctgcagcaggtgcagaagatcctggccatcaccggcgcgcagaaggtcaacctgatcggccacagccagggcgcgcccaccgcgcgctacgtggccggcgtgcggccggacctggtggcttcggtcaccaccataggcggcgtcaacaagggctccaccgtggccgacatcgtgcgcggcgcggcgcctgcgggcacggtttccgaagcggtggccgccgccatcgccggcgctttggccaaggtgatcgccttcttctccggcaccagcgacctgccgcagcagccgattgccgcgttgaactcgctgaccaccgccggctcgctggccttcaacgccaagtttccggccggcgtgccgcgctcggcttgcggcgaaggcgactaccaggtcaacggcgtgcagtactactcgtggaccggcgcggccaccaccaccaatgtgctggatccgctgaccatcccgatgggcgtgttgggcctggctttcggctccactgcctccgacggcctggtggcggtgtgctccgcgcacctggggcaggtgatccgcgacgactacaagatgaaccacgtcaacgaaatcaaccagagcttcggcctggtcagcctgttcgaagtcagcccggtcagcctgtaccgccagcaggccaaccgcctgaagaacgcgggcttgtaagatgcgcaaggcccgtctgttgcttggcttgacgggcgtctgcgccggcctgctggtttggcaggcctggccgcaggcgcagaaaaccgctcctgcctcggcgcaggccggcaaggacggcggtttcgcgccgtccctgcgcggcacgcggccggatggcgcggtcaaggctgcggccgacggcgcgctgcaggtcaatcaggagctgcgccgcctgttcgactactatctggccgcgttgggcgagcgcgagctgccggcgatccgcgccgagctgcgcgcctatctgcagcgcaccttgtccgccggcgccttgaagcaggcgatggcgctgttcgaccgctacgtcgcttaccgccagtcgctggcggggatggcggtggcggcgagcagcgacctggcgcagcggctggcgcgggcgcagtcgctgcggctgcagtacttcttctcgcaggcggaagtggagggtttgttcggcgatgaggaccgttacgacgctttcaccgccaagcggctggccattctggccaattcggccttgagcgcggcggaaaagcagcggcagatcgcgctgctggagcagcagctgccgccggccttgcgcgcggcgcgtgaagagccggtcaagcatctgcagctggcggaggccgaagccgaattgcgcaagcggggcggcggcgagcaggaactgtacgcgctgcgggccggcatggtgggacaggccgctgccgaccggctggcgtcgctggacaaggaggaggccgcctggcagcagcgggtggccgatttcaatcgcgagcgggcggccattctgcaaaacggccaactgagcgatcagcagcgccagcaggcggtcagccagctgcaggcgcagcgcttcagccagcaggaagccttgcggctgggggctttctcgccggccagatagcggaaagcaggataaggaaggaaagcagcgggcgccgtcaggcgcccgttcgcatcagggctgctggctgaacagccgcgccagcgcctcgccgggctcggcttcgcgcatgaaggcttcgcccaccaggaagctgtgcacgccgctgctgcgcatcaggcgcacgtcgtcgacgccggcgatgccgctctcggtgacggcgatgcggccgttgtcgatgcgcggcagcagtttgagcgtggtggccaggctcacttcgaagctgcgcagattgcggttgttgacgcctatcagctcggtcttcagctgcagcgcggcatccagctccgcctcgttgtgcacttcggccagcaccgccatgcccagctcgtcggccagcgcctcgaatgcctgcatctgcggcagctccagcgcggcggcgatcagcaggatgcagtcggcgcccatcgcgcgggcttcgtagatctggtattcgtcgacgatgaagtccttgcgcagcgccggcaggtggcaggcggcgcgggcggcttccaggaagctcgcgtcgccctggaaatactggcggtcggtcagcaccgacaggcaggccgcgccgtgcttggcgtagctggcggcgatggcggccgggtcgaagtcggggcggatcacgcccttgctcgggctggccttcttgatttcggcgatcacggcggccttgcccagcgcatgcttggcgcggatggcggcgacgaagtcgcggcggtcgccgcgggattcggcgtcggcgcgcacgctggcgagcgggcggccgctttgcgccgcggcgatttcctcatgcttggtggcgatgatggtgttgagaatatcggacatgctggcttctgtggtatcgacaacgaatcagccatcatgcagaacatcgccgagtctggcaagtcacgcaaaatgatgtttgcgcgatgcgggcggcggctcggctgcgcgaggctggccgatgcggggccgcgcaagaaaaaaccgcccgggacgggcggttcgcggcgcaggctgccgggttcagcgcgagacgaagccgccgttgatgaacagggtttgggcggtggtccagcggttttccggggaaaccagatgcttgaccagcggcaccaggtccgccacctggcccagctcgccgttgatgcttgcgcgcttcaggtaggccacggtttccggggtttccaccgcgtagaagaattcggtgtccatcgggccgggcgccaccacgttgacggtgatgccgcgctggcccacttccttggccagcgcgcgggtgaagtcctccagcggcgccttgctgccggcgtagacgccgtagtagccggtggtggcggccaagagcgaggtgccgatgctgaggatgcggccgttgtcgcgcaggcggcggccggcttcctgcaggcagaagaaggctgccttggtattcagggcgaagatggcgtcgaactcttcctcgctgacctcggtgaccggctttttcaccatcatgccggcggtgttgatcaggatgtccagatggccgaagcgcgcttccaccgcgtcgaacaggcggcgcacttccgcgatcttggtgatgtcggcctgcacggcgaaagcctggccgccggcggcaaggatctgggcggcggcttcttccgcgccggcgcgggagccggcgctgttgtagtggatggcgacggcggcgccgtcggcggccagcgcctcggcgaaggcgcggcccatattgcgcgatgcgccgactgccagcgcgacttttcctgcgaagtgggattggctcatgtttgctgctccgttggctgtgccgcatgtcgcggcgggtgttgacgcttcgcagtgtattgtttggatatctcctgataaatatgatgattttgattacactatccataaagtcgatctaattggagcaggcatggaccggattcaggcgatgcaggtattcgccaccgtggtggacgccggcggcttcaccaaggccgcgcagcagatgcagttgccgcgcgccacggtgtccagcgcggtgcagcaactggaggcgcagctgggcgtgcggcttttgcaccggaccacgcgccgggtgcaattgacgctggacggcagcggcttctacgaacgctgccagcagctgctggccgatttcgaggaaatcgaggccttgttcagccagcagggggccaatccgcgcggcaagctgcgcatagacgtgccggggccgataggccgccaggtgctggcgccggcgttgccggagtttttccgccagtaccccgacatccagctggagctgggcgtcaccgaccgcccggtggacctgattcaggaaggggtggattgcgtgatccgggtggggcagcttggcgagtcgcggctggtggcgcggcgggtgggcatgctggcgcaaggcaattacgccagcccggcctacctggcgagtttcggcgaaccgcgcagcccggacgatctggcgcggcaccaggcggtgaactacgcgtcgccgtccagcggcaaggtgttcgcctgggagtggcagcgcgacggcgagtggcaggagagggcgctgagcgccaaaatcagtgtcaaccaggtggaaacctatctggcctgcgcgctggccgggctgggcctgatccagttgccgcgctacgatgcggcgccgcatgtggccgccgggcggctggttgaggtgctggccgactggccgccgccggcgatgccggtgtcggtgttgtatccgcaccggcgccatttgtcgcggcgggtgcaggttttcgtcgaatgggcctcggccctgctgcgggagcggctgggtttggccgactagcggctatcgcgccgcggcaccgccaacacccgcggcgggtggccgcagtgccgcaacagccgctccaggtcggccaccggcacgctgagcgtggcggtattcaccagcggatggcataggatggcctccgccgcccacagttcggcgtccaccaccacctgcaccgcgtcgtcgcggtcgttgaccgccgccagcagcgtcaccgatcccggctccagccccaggtggcgcttcagcctttccggcgaggcgaaacgcagccctttggcgtccagcgtttcgcccagggccttgatgtccactccggccgcggccggcactgccaccagaaaatgccggcggcccttggcgtcgcataaaaacaggtttttgcactccgcgccgggcaggtctggaatcagtcgcgcggcctcttcgcaggtatagaccggcggatgctcgaagcgttgatagtggacctgctgcgcgtccagcaggcgatacagcgcgtgttccatgcagtgttctccggcgtttcgttccgtttgaaactatcacggcgccgccgcccgcgtcaccccgccagtttcatgatcaagccttccagcgccgccagcgccgcttccggccggccgtcgatctgcgcgcgcacgatggcgccgtcggccgccagcgccagcatgtctgccaagccggctggggccgggcgggccggcagcagcgcggcgatcgcatcgcgcatttcgcttttgtgccggcgcgccgcctcggccagctccgcttcggccggcatttcgccgacgccgttgatgaaggcgcagccgcgaaagtcgtcggaggcgaaccattcccgcagcgcctgggccagcgccatggcgccgtcggcggcatggcgcgccaacgcggcgcgaaagcccgccatccattgctggtggcgttgttccaggtaggcctgtatcaagtcgtgcttgctggggaagtggcgataaaacgtcaccttggtgacgcaggattcggcgatgagccggtctatgccggtggcgcgcaggccttcgcggtagaacaagcggtgcgcggtggcgaggatgcgttcccgcgccggcagcgcggcgatgccgctggatggattcggtttcatgaaagtgattgtagacagagttgtctacttaagtctagactggtttgcgtgtagacaaatctgtctacttaacctgaaaaggaaacatcatggaaaaccgcccgccgctgccgccgttcactcgcgaaactgcgatcgagaaagcccgcctggccgaagatggctggaacagccgcgatccggcccgggtggcgctggcctacagcgtggatacccgctggcgcaaccgcgtcgactttcctcagggccgggccgaagccgaggccttgctggcgcgcaaatggaaacgcgagctggattaccgtttgatcaaggagttatgggcattcgacggcaaccgcatcgcggtgcgcttcgcctacgaatggcatgacgacgccggccagtggtaccgcagttacggcaacgagaactgggccttcggcgccgacggcctgatgaccgaccgccacgccagcatcaacgacatgccgattgcgcaagccgagcgccagttcttctggccgctgggccgtcgtccggacgaccatccaggtttgagcgatctgggcttgtagccgtggacgcggcgggccgcgcggacgcgcgcgcctgccgcttgggcaatggaaataggtatggacagcgggacatgcggctgattagtatcaatgccattgacattgcggcccaggccgacatcacatggagttttgcccatgcttgaaaccatccggcagcgcttcctggcgctgcaaccgcaggcggatttttgttcgctgcgctacgtggaggaagaccgcgaacggctgcatgtccggcaggggcggcagcagccgttgagccgcagccacgaccgcggcgcgatgatcgtcgtgatcgatggcggcggctatggctatgcggccaccgccgacctgagcgaggcgggcctgcgcgccgctttcgcgcgggcgaaggcgtgggcccgcgccacggccggctgcggggtgttcgattaccgccaagtcgagttgcccagcccgtccggccgctacgccggcccgggcagcgagagcgaggctccgtggcgccgcgctgaattgctgggtttgctgatggaggaatctgccgcggccaagggcgaggacgcgcgcatcgtggattggtcggccggcctggtgcggcaggacatccgccagctctacctgacgtcgcgcggcggcgaggcggagcagcgtttccgcatgctgacgccgtcgttgacggtgacggccttcgccgacggccgagtgcagacgcgcagcctgggcggccagtatggcggcatggcgcgccagggcgcggaggaggcgttgatcgcggaggccggcctggccggcgccggccgccgcgtcgccgacgaagccttgcagctgctgcatgcgcccaattgcccgagcggcaagatggacctgctgctgatgccggagcagatgatgctgcagattcacgaaagcataggccatccgctggagttggaccgcatcctgggcgacgagcgcaattacgccggcaccagcttcgtcaccctggacatgttcggccattaccagtacggctccaacctgctcaacgtcaccttcgatccgctgcgccgccaggaattggccagctatggctgggacgacgacggcaaggccgccgacaagacgtggctgatccggaacggcgtgctggagcggccgctgggcggcgacatctcttcggcccgggccggcttggaggagatcgcgctggacggggtggcgaacagccgcggctgcaactggaaccggccggcgatagaccggatggccaacctcaatgtcgaacccggcgacaagactttcgaacagctggtggccggcgtggagcgcggcgtgctgatgcagaccaatgtcagctggtcgatcgacgattcgcgcaacaagttccagttcggctgcgaatggggccagttgatagaagacggcgaattgaagggtgtggtgcgcaatcccaattaccgcggcatttccgccaatttctggcgctcgctgcgggcggtgggcgacgagtctacgctgtcggtgctgggaacgccttattgcggcaagggcgagcccaaccaggtggtgagagtgggccacgcttcgccggcctgcgtgttcggcgaggtggatgtattcggaggagcggcgtgatgcgggcgcatttcaaattattggcgaacgaactgaagcggcagctgcgggagggcgagggctttaccctgtggctggaggccgagtccaccgatttcgtcaggttcaaccatggcaaggtgcggcaggccggctcggtgcggcaggcgtatctggatgtgcgcctgctgcggggaagccgccaggtcacgcagcagctgtcgctatccggcgacgaccacgatctggccttgctggagagcagcttgccggccttgcgcgcggcgctggacgatgtggaggatgatcccttcctgttgctgaacgacaagccgcaggacagcgaacggctgtccgctgcggcgctgccggacggcgcggccatggcggaggatatcctggccgccgcgcgcgggcatgacttggtcggcatcctggccgccggcgagatgagcttcggcttcgccaatcatctgggccaattcaattggcagcagggcggcagctggaatttcgactggagcctgcatgcgtttggcgacaaggccgtgaagcgcagcatggccggcggcgaatgggacgcgggccggctgcgcggcgccatcgacgaggcggcggcgcagctggagtggctgaagttgccgcccaagacgctggagccgggccgttatcgcgcttatttcacgccttcggcgctgggcagcctgctgtccatgctcaactggggcggcctgtcggaaaaagaggtgcgttccaagcgcagccccttgttgaagctggccgccggcgaagtcggcctgtcgccgttggtgacgttgacggaggatgccgcggccggcctggcgccgatgttccagagcgatggcttcatcaagccggatcaggtgggcctgatcgtcggcggcgcgcaccgcaacagcctgatcgggccgcgcagcgccggcgagttcggcttggcgcccaatgccggcgcgcatgagatagcggaatcgttgcggatggaggcgggggccttgccgcagcagcaggcgctggaagcgttgggcaccggggtgtacctgtccaatctgtggtacctgaacttttccgaccgggccgcttgccgcatcaccggcatgacgcgtttcgcctgtttctgggtggagggcggcaagatcgtcgcgccgctgggcgtgatgcgtttcgacgatagcctgttcgatctgttgggcgggcagctggaggcgctgaccgccgagcgcgaattgctggcggacgccagcagctacggcggccgcgccacccagagcaaactgctgcccggcgccttggtttcctccttgcatttcagcctgtaagggctgcatctggtcggctgccagcttcgagggggctggcggccaccttgcatgtatccatgcaattttcgcatgtttaatgccttctgcatgggtgctgctgcatcgcatggcctgctgccgccatgattttgcttggaattctttccattccagacaagccggggtatgctttctcttcattgcacatccgctaacgtgacggattagcaagcgccgtcggcgggccgggatttctccccgcgcagcggcgtttcatcatttttccagctttcgccgcgatggcgaatgttgtgccaggcgacgcggctgaccgcgcgccgcgaactgaatcaaggaatgcgttgtgaccgatatcgcccaactcgaacccaaagccgtctgggaacacttccaaaccctgtgcgacattccgcgcccgtccaagcacgaggaacaggtgcgcgactacatgaaaggctgggcggagctgcgcggcctggaaaccgtcgtcgacaaggtgggcaacctgatcatccgcaagccggccacgccgggctatgaagaccgcgccggcgtggtgctgcaaggccacctggacatggtgtgccaggccaatagcggcaccgagcacgacttcttcaaagacccgatccgcccggtattgaaagatggctggctgatcgccgaaaacaccacgctgggcgccgacaacggcatcggcgtggcgctgggcatggcggtgctgtccggcgacgacgtcgcccacggcccggtggaagtgctgctgacgctggacgaagaggccggcatgggcggcgcgctgggcctcgagaccggcctgctgcaaggccagtacctgatcaatatcgataccgaagagtggggcgagttctacatgggctgcgccggcggcgtggatgtcaatgtcagccgcgaatacgcggttgaggccgtgccggccggcttccagaccgcgagcctgaccatcaaaggcctgaagggcggccactccggcgccgacatccacctgggccgcggcaacgccaacaagatcctgatccgcctgctgcgtgaattggaggcggaaaccgaactgcgcctggccacgctcaagggcggcacggcccgcaacgcgctgtcgcgcgaggccttcgcggtggtggcctatccggccgccgacgccgccaaggtggcggccaagctggatgccttccaggcgctgatgcgtttcgaactggctggcgtcgacgaaggcgtggcggtgttgtccgaagccgccgccgctgccggcgtgctggctcgcgccgaccaagccgccattctgtccgcgctgcatgcggcgccgcatggcgtcaagcgcatgagccagcgcgtggacggcgtggtggaaacctccaacaacctgggcgtggtcaccgtggccgacggcaaggttttcgccaacctgatggtgcgctccctgctggattccggcacctggatgctggcgcgcgaagtggaaagcctgttcaagcttgccgcgttcaaggtggaaatggaaggcggctacccgggctgggcgccgaatccgggctccaagctgctggccttgttcaaggacgtgttccgccaggaattcggcggcgaagccgaggtgcaggtgatccacgccggcctggaatgcggcatcctgggcgccaaatacccgaatctggacatggtgtccttcggcccgaacatccgcggcgcgcacgcgccgggcgagcgagtggaagtggagtcggtaggcaaggcctggcagttgctgcaggcggtgctgaaagccattccggcgcgttgatttcccgctttgtctgaagagcggcctgactgaaaagtccggccgctttttcatgggcgcgcggcgcgggcggcgatggtgtcggtttcgccgggccggcgcggcgtcagtcggcttgcttgccggcgccgcgcggaccctggccggagaaatggcggccgaagcctatgatcaccagcgcgctggtgaagatgatctgcaagtcggcgagcagccgcaccggccagtaggtggggtacatgtcgccatagccgacggtggcggcggtggcgatggacaggtggaagcaatcgaggaacagcaaggcggcgtggccgtagaagccgggcaggaagccgccctggccgtcgtacagcgccgtcatgccgtggaaggcgctgccgccggtcagcagcagcgcgaacaggtagtacaccacggcgaattgcagcaccaggccgacgtaaaggccgatcaggtcgcccaattggcgttggcgcggccgccgcaggatgtgccgcacggtgcgccacagcggccagaagaacaccgcccaggccagccattgctcgccctggcgcggcagcagcgcatgcaggcccgcgccgtgccacagcagagtgagcagagcggcgcaggccagagacagcgccgtttcggcatgcaattgcagccgggtttccaggctgggaagcggcagagacgccatcagccggccagacgctggcggatgctggcctcgatgccggcggcgtccaggccgcatttggacagcagcagcgccgggtcgccgtgctcgacatagtcgtcgggcaggcccagctgcagcaccggcgtgctcagccacatttcctgcatcgcttccaggcaagcggagccggcgccgcccatcaccacgttttcctccacggtgacgatcagctcgtggctttctgccagcgtgcgcaccagctccatgtccagcggcttgacgaagcgcatgtcggcgacggtggcgtccagcgcttcggcggcggcgagggcggggcgcaccatgctgccgaaggccaggatggcgatcttgccgccctggcggcgaaccacgcccttgccgaccggcagcgctgccatctgctgctggatttccacgccggggccggtgccgcgcgggtagcggacggcagtcgggctgtccagctggaaggcggtgtacaacagctggcggcactcgttttcgtccgacggcgcgatcaccgtcatattggggatgcagcgcaggaagctgaggtcgaaggcgccggcatgggtggggccgtcggcgccgaccaggccggcgcggtccagcgcgaacatcaccggcaggttctgcagcgccacgtcgtggatcaactggtcgtagccgcgctgcaggaaggtggagtagatcgccaccaccggcttcaggccgtcgcaggccatgccgccggcgaaagtcaccgcgtgctgctcggcgatggccacgtcgtagtagcggtccgggtgctctttctcgaagcgcaccatgccggagccctcgcgcatcgccggggtgatgccgaccaggcgcttgtccagcttggccatgtcgcacagccagtcgccgaacacctgggtgtattgcggtttgccgccgccgctcttggcgccggcgaggccgttggcagggtcgaacttggtgacgccgtggtatttgaccgggtcattctcggccagcttgtagccctggcctttcttggtgacgatgtgcaggaactgcgggcctttcaggctcttgatgttcttcagcgtgtccaccagcacgtccacatcatggccatcgatcggtccgatgtagttgaagccgaattcctcgaacagcgtgcccggggtgaagaagcccttgacgtgctcttccaccttgctggcgatttccttcaaaggcggggcgatgcccagcaccttgctggagccttcgcgcatcgccgcgtagaagcggccggacatcagcttggccaggtagttgttcagcgcgccgacattgggcgagatcgacatgtcgttgtcgttgaggatcaccagcaggtcggtgtccatcgcgccggcgttgttcagcgcctcgaaggcctggccggcggtcatcgcgccgtcgccgatgatggccacgctcttgcgctccacgcccagcgtcttggccgccaccgccatgcccagcgcggcgccgatcgaggtggacgaatggccgacgccgaaggtgtcgtattcggattcttcgcgcttggggaagccggccaggccgccgtactggcgcatgctgcccatctgctcgcggcggccggtcaggatcttgtgcgggtaggtctggtggccgacgtcccagaccaggcgatcgtgcggcgtgtcgaacacgtaatgcagggcgacggtcagctcgatgctgcccagattggacgcgaagtggccgccggtcttgctgaccgtttccaccaggaattcgcgcagttcgcgcgccagctgcggcagctggttgcgggacagctgccgcaggtcggcggggctgttgatgttttctagcagcggatacattgtttggtctgcagtggtatggctcgccgggcggtgggccgccctggttcgattgctggctttacgagcggttcaaaacgagcgggcgacgatgtagtcggccagttgtctcaggcggtcggcgcgcgggccgaagccctgcagcgcggcgaaggcctggtcgtgcaaatccttagccatgcgcttggcctcggcaaggcccagcaggctgacgtaggtgggcttgtcatgggcggcgtccttgccggcggtcttgcccagcgtggcggtgtcggcctcgcaatccagaatatcgtccaccacctggaaggccaggccgacgcgcttggcgaacacgtccagcgcttctttatccgcggcggacagttcactgcctgccatcgcgcccatcagcaccgaagcgcggatcagcgcgccggttttcagcatgtgcatgaattccagctccggcggcgtcagcggctggccgacgctggccaggtctatcgcctggccgcccgccatgccggcatggccggaggcgtgcgccagcgtgcgcgccatttccaattggctggccggggcgatgcccggcagcggctgcgaaatcagctcgaaggcgcgggtttgcagcgcgtcgcccactagcagcgccgtggcttcgtcgtaggccacgtgacaggtgggcttgccgcggcgcagcacatcgtcgtccatgcagggcatgtcgtcgtgcaccagcgaataggcgtggatcatttccagcgccgcgccgacgcgggccaggttttccggcttggcgtccaccagctcgccggcggcgaaggccagcagcgggcgcacccgcttgccgccttccagcgtggcgtagcgcatcgcctggtgcaggcgctgcggcgcggcatcggcggcgggcagcaggcgttccagcgcggtttccatttgctgctggatggcggtcatccagccgatgaaggtttcattggccattgggcagatccagcgccttcagttcgttgttttccaggattttcagctgctgttccgcgtcggcgagcttggcctggcagaacttgatcaattcggtgccttgcttgtaggaggcaagggctgtttccagcggcagatcgccgctgtccatcgcctggatgatgtcctccagctgggccagcgcgctctcgaagctggccggcgctttggcggcttttgccatggcggtattcctcgtgcgtgtcaggccgacattctagtccaattccacggcaaaacgacagtgccgctgtcagatgtttgtcatgtggccgattccggcgccgcggcgattggtgtagggttggacgtttgcccatcgcgcgaggtttttcatgtcagacatccagccttccatcttgatcaccggttgctccagcggcatcggctaccacagcgcgaaagtgctgagccagcgcggctggcgggtgttcgccagctgccgccgtccagaggacgcgatgcgtctgcgagaggagggactggagtgcctgcagctggatgtggacgaccccgcgtccatccaggcggcgctggccgaggtgctggaacgaagcggcggtcggctggacgcgctgttcaacaatgccggcttcggccagccgggcgcggtggaggacatttcgcgccaggcgatgcgcgagcagttcgagaccaatctgttcggcccgtgggagctgaccaacgcggtgctgaaagtcatgcgcgcccagggctacggccgcatcgtgttcaacagctccatcctgggcttcgccgcgatgcgctggcgcggcgcctacaacgccagcaaattcgcgatggagggtctgtgcgacacgctgcgccatgagctgcacggcaccgacatccatgtctcgctggtggagccggggccgatagagagccgtttccgccccaacgccttggcgcgtttcttgaagaatgtcgatatcgacgccagcgtgcaccgcgacaactaccagaaacagttggaaaggctgaaaaaggaggggcacgccgcgccattcacgctgccggccaccgcggtggccgaggcggtgtggcgggcgatttcctgccgccggcccaaggcccgttatccggtgacttttcccaccaaactctactggctattgcgccgctggctgccgcagcgctggtacgaccatgcctgccgcagcgccacttgatggacatgcttttggcatttgaattttgttgatgccatcttgataattttttgttgatttacctggcatgttggctttacattcattcgcgctgctcatggctgcttcggcacagccctctgggcggcgacaagaagatgggggctgatcacggctcctgcgctacgaaggagataaaacaatatgaagcacctgaaatggctgcccatgctgctgatgggcgtggcactcatgcctcatgcccaggcggccgatcccggcaaagtgctcagggtggcgttttccgcgccagagaccggattcgacttggtcaaagtgcacgatgtttattccatggcggttggcgagaacatctttgacggcctgctgacctatgactacctggcccggccgttgaaagtggtgcccaataccgccagcgcgatgcctgaggtgtcgccagatggcaaagtctttacattcaaggtgaaacccggcatttattttgcggatgatccggcgttcaagggcaagaagcgggagttgaccgcggcggactacgcctacactttcaagcgtttcgccgatccgctgaacaacgctcccagcggcgcgtcctatatggatttcatcgccggcctggaagaggcatccaaaaaagccgctaaaaccggcaagttcgattacgacacgccgatttccggcctgcaggtgctggaccgctacacgctgcgcatcgtattgaaaaagccgaatttcggattcctgtacaccatcgccgccaaggattccggcgcggtggcgcgcgaagtgatcgagacctatagcaaagacaccctttcccatccggtcggcaccggtccgttcatgctgaaagagtggaagccgggcaaccgcattgtgctggtggccaatccgggctatcgcaagacggtgttcgacggctcgccgggcagcgagccgggcgacgcggaaatctaccggtcgctcaagggcaagaccttgccgcaagtgggccgggtggaaatccgcatcatcgaggaagaccagccgcgctggctgtctttcatgaacaagcaactggactggatcaacgtgcctaagtcggcgatgaagtccgcgttgaacatcaatccggccgacccttacgacaccaccctgcggccggtgctcgccaagcgcagcatccggcttagccatacgctcggcttggatgtcacttacgcctatttcaatctgaaagatccggtcatcggcggttacggcaaggataaagtcgcattgcgccgcgccatcgccatggcctatccgttgcagaaggaagtgattcctctgttatacggcaatcaggccattccgcttcaggggctggtgcctgtcggcatggtcggttttgatccgcatttccagggacaggtgccttacgacccggctaccgccaacgccttgcttgacgagttcggttacaagatcgggccggatggctatcgcaccctgccgaatggcaagccgctggtcatagagcagggcactcagtcctccgcgaccgacaagcagttcaatgagatctggcagaaggcttttgacagcatcaaggtgagagtgcgcttcaaaaccgccaagtggaatgagaacctgaaggcggcttacgcctacaagctgcagatgtggagcctgggcgggtcggcctcgacgccggacggcgacgatttcgtctccagcttttcctcgcgcttgatcggccagggcaatctggcgggctatcaggtggcggcttacgacaaggcctacgacgcatcgcagatactgccggacggagcggaacgtcaggccttgtacagcaagatgaaccgcctggtcgcggcgcagcagccctatgtgctgggcgtcacccgcttttacaacgaattgacccagggttacgtcagcggtttcaagcgccaccccatttccactttcggcggtttctggcgttatgtggacgtcgcgccgcactgatcgcctgagcgagggaaaatcatgattgcatatgtcattcgccgtctctggcagatgatccccaccatgctgggcgtcatgctgctggtgttcgtgctgttcaactgggtgggcggagatcccacctatattctggaaggcaagcgccttacgccggaaatgatggccaacttccgcgcccagatgggcctggacaagagcctgcccgagcaattcctgctgttcgccaagcaagtgctgacctatgacttcggcaactcgtgggccactcagcattcggtggcgcatacgctggccagccgggtgggcccttcgttgctgctggccggcagcttgctggtgctggagctgttcactgcgctgcccatcgccgtggcggtggcttatttccgcggcggcctgaccgatcgtctagtcacgctgatctgcacggtggcgatgtcgatcagctccctggtctacatcatcgtcggccaataccagcttggcttcgcgctggattggttcccggtgatgggctgggacgacgacagcatcgtcgccaatctgttcgtctatctgcctttgccgttgttgctgggcctgctggtgtcgctggctcccagcgtgcgcttctaccgcagcttcatcgtcgaggagctgaaccacgattatgtgcgcaccgcgcgcgccaagggtttgtccgaacccaaggtgctgttcaagcacgtgctgcgcaacgcgctgatcccggtggtgaccaacatcaccatgtcgctgcccttcctgatgctgggctcgatgctgctggagcgcttcttcggcattccaggcatgggcaacgagctgctcaacgcggtggacaagagcgacttcccggtgatcaaggcgatcaccatcaccatcgccgcagccgccatggcgttcaacctgctggccgacatcctctacaagtggatcgacccgcgcgttcagttgaagtgagcgggggagagataaatgacgacattgcagaataccgccggcgccgcgccggccgcgccatcccgcagcctgtgggcgctgggttggcaaagactgaagcgcgaccgcatcggtttcgcgtcgctgtggatcgtggcggctttcatgctgctggcgctggccagctggctgggcctgatcggccgcggctggaacgacgagatcgccgtttcctacgcgccgcccaccgcgatctaccagcaggacaagtcggtcgccgtgcacaagtccaaggccgccgaaccggcgctggaaggcttgaaaccggcggaagacccgatctgggcggaaacccagcgcgcccgtcagaaccgcgacaaatacgtggtgccggaagtgaagaaggcggaatcgctcaccttcggcgccgatcagcgcggccgcgacatcctggacaaggtgatcaagggcacttccacctcgctgttcgtcggcttcttcggctccttgctggccatcgtcatcggcgcggcgctgggcgccagcgccggtttcttcggccgcaaggtggatgatttcctgatgtggttctacagcgtgttcaccgcgatgccggacatgctgctgctgctggctttcgccgcggtggccggccgcggcctgggcaccgtggtgctggtgctgtcgctgaccacctggaccggggtgttccgcctggtgcgggccgagttcatcaagctgcgctcgcgcgaattcgtgcaggccgccgacgccatcggcgccagcagcgcgcggcggatgttcgtccacatcctgcccaatatctcccatctgctgctggtgcagttctccttgctgatggtcggcctgatcaaatacgaggtgatcctgtccttcctcggcttcggcgtcgacgtgcgccaggtcagctggggatcgatgctggccgaggtgccggaggagttgctgcagggctattggtggcaactggcgatggtggtggtgttcatgtcggtgctggtgacggcgttcagcatgctgaccgattccctgcgcgacgcgctggaccccaaggtaaagtgaggatcacccgatgagcaacaacaaacctttgctgtccgtgcgcaatctgaaggtgggcttccgccaggaagacggcggccgcttcgaggcgctcaagggcgtcagcttcgacattccggcccaccgcacggtggcgctggtcggcgaatcgggctccggcaagtcggtgacgtcgatggccatcatgcagctgctgccgccgcaatccagcgagatcgatccggcgtccgaactgctgttccagggccgcaacctgctgcggctgtcgcgcggcgagctgcgcaagctgcgcggcaaggacatcgcgatgattttccaggagccgatgagctccttgaacccggtgttcagcgtcggcgagcagatcgtcgagacgctgacccttcacgccggcttgagccgttccgccgcctggaagcgcgcggtggagctgctgcgcgaagtgggcctgccggagccggaaaagcgggtgaaagcctacccgcacgaactgtccggcggccagcagcagcgggtgatgatcgccatcgccatcgcctgcgaaccgaagctgctgatcgccgacgagccgaccaccgcgctcgacgtcacgattcagaagcagatcctgcaactgatcgccgacctgcagaagaagcacggcatgtcggtgctgttcatcacccacgacctgggggtggtcggcgaattcgccgacgaagtgatcgtgatgcgccacggcgtgatccgcgagcaaggcacggtgaagcagatcttcgaaaacccgcaggacgcctacaccaaggcgctgctgtcgtgccggccgcacctggaccgccgcccggagcggctggcggtgatcgacgacttcctccagccgggcggctatgtcgaaccggccgaaaggacacgtggctacgccgccggcgacgaaatcgtgctggacgtgcaagggctgtgcaagagcttcgacatccgcgaagggctgttcggcaagcgccagttccacgcggtgaaggacgtgtcgttccagttggcgcgcggcaagacgctgggcatcgtcggcgaatccggctcgggcaagaccaccgttggcctgacgctggtgcggctgcaccaggccaccggcggcaaggccttgttccacggccaggacctgatcggcatgagcgccaaggcgttccacgcctacaagaagcggatccagatcatcttccagaacccgtacgcgtcgctgaacccgcgcttcaccgtcgagcagatcctgaccgagccgatgctgctgcacggcatcggccaggacggcgggcagcgccgcaagctggcgctggacctgctggacaaggtggggctgccggcgggcgcgctggccaagtacccgcacgagttctccggcggcctgccgctggccgccggagaactcgtgcgggtacttggccagcgcgcccgccggcagccccaccttgtccagcaggtccagcgccagcttgcggcgctgcccgccgtccncctcccccccacccaaagccggcgccatttgcgtcaccggaaaacgcctaatcccgcgcatggctgatttcccgccgcagtaaagccagccacccgcttgcaaggcggcagggccagctgcggacgcgatcatccatttgatcggatccagagctggccctgcctgtcatattcgccgcgtcttgccccgccgacggaatgccgccctttatcttgcgcgcatccccccgcccttgagtccgactccggaaaatcaaatagatagtgatatcaagcttgcgtaaaagtacgaattgaacaatgcgcagccattacttacaacaaacttatccataaaaacaaaccgcatgatcgcgcgccatttcccggcattgccggccgcctatacgccgccggcgcaaaataaaccgcagccatgccgaaaagattgcccgcgcggccattctggaatcgctcctcaacgccctgcccgcagtgacgccggattttccggtcctgctcctccccggtcgccggcggccgccccctgacgacggcgcgctccgcctcgcgcccatcatttgaagggaagcgcccatgaacgacccgatacccctgtttctggatatttcatcccagctgaccggtttcagcgcgaccgagctggaagccaccggcatggccagcctctactgggacaccgtcctgcgccagaaccccccggccgatgtcgaaggcttcctgtcctgttcgcgcagaatcctgcaggagggcggaggcgatgaaaccgccatccacgagatgatcgccgcccagctctttcccgtcagccagttcggcggcctcgcgcagaacctcatcaatctctggtacctgggccaatggattccggccaaccagaacttaggcctggccatgcagcacaacgtcagcagcgaggcctatgtgcagagcctggtctggcgcgccgcccaaacccatccgcccggcgccaggcagcccggcttcggctcctgggcggaaaagccgctcaatcccaactgatcccgtgcgcaagcacacccatcaagcgagcccatcatgcgcgactcccaatacgacgttgtgattgtcggcaccggcatcgccggcgcggtgctggccaaaagcctcacccaggctggcaagcgggtgctgatgctggaagccggactgcaagccggtctggagctggacgccgaatccgcgttcgccaactaccagtcttatgtcgacaccttccactacaaggccaacccggccaccaacggcccctatccggcgctgcaggatgccccgacgcccaatgtgctggacatcgcgctgggcgacccgatggaccagaccggctacctggtgcagatgggtccgctggccttcggcagcgactgcctgcgcaccccgggcggcaccacgctgcactggctgggcaatgtgccgcgcatgctgcccaacgacttccgcatgcagacgctgtacggccgcggcgtggattggccgatcagctacgacgagctcaagccctactacgaactggccgagctggagataggcgtgtcaggagatgcggccgcccaggtcggcccggacatgggccgcgccaactacggcgccggctacgtgtttccgatgcaggccatcccgcagtcgtaccaggacaaggtgtggatccgcaacgcccagggcgcgaaggtgcgggtggacggcgccgactacgacgtcagcttcatcagcatgccgcaggggcgcaactccacccccaatccggactatccctactccgccatcgcctgggagccggcctcgcagcgcttcgctccgcagcgagtcggcgcgcagtatcaagtcatagggtccacctggtcgccgtataccggcgagcgctgcgaaggcaatgccagctgcgtgccgctatgcccggtccaggccaagtacaatgcgctgaaaaccctgaagcaggctgaccgcagccggctgaccatccacacccaggccgtggcgtccaaagtgcggatcgacccgcaaagccggcgggtgaccggcatcgaatacaagcgctaccagaagccggacgccggcggctacaccaaccataccgccgagggcacgctgtacgtgctggcggccaacgcgctggaaaacgccaagctgctgctgatgtcgggggcggccaacagcagcgaccaggtggggcgcaacctgatggaccaccaggtgatgctgacctgggggctgttcaagcacgaaaaggtctatccctaccgcggcccgggctgtaccacctacatccccactttccgcgacggcgccttccgcaaggatttttccgcgtggatctccccggtggacaactggggctggtcgtggcccgttttctcgcccggcagcgatctaagcgacggcatgaacaagggcctgttcggcaaggcgctgcgcgcctatctggccgaccgcgtgccgcgccaggcgctgttgcatttcgagtgcgaacagctgcccaggccggaaaaccgcatcaccatagacgagcgcttcctggaccggctgggcaaccccaggccggtgatccactactcgctgtccgactacgagctcagggccttcgccgccgccaaggaagcgtcggaccagatcttcgcccaggcgcagatcaaggactacacgcattaccccgccaacgagggcgaccaggacgtggtgcagtggcagggcaagacctatcagttctggggcgccggccacatcgtcggcacgcaccggatgggcagcgaggcggccagctcggtggtgaagccgacccagcaaacctgggaccacgacaatctgtatctggtgggctgcggcaatatgcccacgctgggcacctccaaccccaccctgaccctgaccgcgctggccttcatggccgcggaaaacatcctcaagcaactggactcgccatcccgccaaggagacgctcatgagcaatgactacctcgtccagaccgcccagggccgccgccgccaacgcctggtccgtccgctgcaaagcccgctgcaggcgctgcgcttcaccgccgagccggcggagtttcaagttagcggcaccatcaaaaccctgccgcaattgcgcgagcacctgcaaaccgccatccagctggaacacaccaccattccgccctacctgaccacgctgtacacgctggatgaacgccgcaatcgcttcgcctaccaggcgatacaaggcgtggtgatggaagagatgctgcacatgatccaggtttgcaacatcctcaacgcccttggcggcagcccggccatcaacacgccgcacttcatcccggaatacccggccccgctgccccacagcgacaacgcgttcaaggtgccgctgcaaaaattctcgcccgacaccataagcgttttcctgcagatagaaatgcccgcgccaagcgacgcgccgcccgaggccaaccattacaacagcatcggccagttctacgatgccatccggctggcgatagaggagctggacgccgaaaactggctgaagcatggccgcagcctgtttgacgagtttccggaaaaagccggctatcaaatcctgcccgagcactattacggcggcggcggcaaactgctggcaatccgctcgctggaagacgcgcggaacgccatcgaggaaatcatcggccagggcgaaggcgtggatggcaccatcatcgataccgacagcattgagttcggccaggatgtcgaatacgcgcactacttccgcttcaacgagatcaagcacgcgcggcgctatctgccggacgacagcgcgcgcctgccgcccaccggcccggccgtggaggtggactggaacgcggtcatcgacatggcgcccaaccccaggatggccgactacccggaagattcgccgctgcggcggcagtcctgggaattcaaccgcacttattgccaattgctgaacctgctgcacatctcctgcaacggcaagcccgaccggctgggcgaggcgataccggtgatgtaccagctcaagtaccaggcccaggccttgctcaaccttcccaacggcgccggccaaagggcggggccaagcttcgaatacgttccgctgtaagcccatgccgggttaacaaaggcggcgcggcccaccgcgccgccttccccagcgccctccccgccacaaaacccgcccgcccgcgcccatcttgcgctaccctacgcgccgtgaatccaaacccgcggccaagagccgcgcctgcggcaagaaaccagacatgcgcatccaggaactgcaccaagccctagccgacatcggcgcccgcccctgccacatcggccgtatccatcgcgcctggctgcaaggcctgccgctggatgccggcaccagccggcaaaagagcgaagactacttcccgctgtcggtgcgcaacggcctgccgcccatcgccgcgcggctggaagcgctggcgcgcgtccactcgcgacaccccgccgccgacggctccttgcggctattggtggcgctggccgatggccagatggtggaaagcgtgctgctaccacgggacggcttgtgcgtatccagccaagtgggttgcgcggtgggctgcaccttctgcatgaccggcaagtccggcctgctgcgccagctgggcagcgccgaaatcgccgcgcaggtggcgctggcgcgccgcatccgcccggtgaagaaagtggtgttcatgggcatgggcgagccggcgcacaacctggacaatgtgctggaagcgatagactggctgggcaccgatggcggtatcggccacaagaacctggtgttttccacggtgggggacccgcgcgtgttcgaacggctgccccagcagcgcgtcaagccggcgctggcgttgtcgctgcacaccacccgcgccgacctgcgccagcagctattgccgcgcgcgccgcggatagacccggccgagctggtggcgcagggcgaaacctacgcccgcctcaccggctaccccattcagtaccagtggacgctgctggccggcatcaacgacagccagcaagagatggacgccatcgcgcgcctgctcaagggcaaattcggcgtgctcaacctgattccctacaacagcctggaggccgacagctttcagcgccccgccgccgaacgcatagaagaaatgaagcgctatctgcacggccagggcgtgctgaccaaggtgcgcgactccgccggccaggacattgacggcggctgcggccagctgcgcgcgcggacggcgcacgtgatagacgccagccggctatcgcggcgggagcaggccggcatagcccgcgcgtaagccgtccatcccgcggcaggccaggcgcggcaaaaaaccgcatcgcatccaaaatgcattaacatccaaagttgccgaaccatatgcaatggagatgccaccatgcctgcccgcaacgccccgcccgtagtcgacctgcttgccatgcagccgggcgacatcattctttcgcgcagcgtctcgtccgaccgcaaattgattttcgcgcaacgcgtgctgcacccgacccgcgacctgctgcgcgcccgcagggagttttgcacccatgccagcgtatacctgggccacggcctgctggtggaagcggtgcgcgatggcatcgccctgcgcgcccttagcctgaaagcagacgacttcttccacgatgcgcccgccgcgctctcgcctgacgccgcgccgccaaaactacgcgtcaactatcgcccgcaggccgacggctatgaatatttccgggtagtccgactgaaacaggacgccgccgccctgggccgaggcatcgcccaaaccgcgctggacttatggggcggggattacgccagcgtgaaggaattcctgaagtttctgcccttgcatccggccacggggaagatcagcggcggcgcaaaggaacaaggcgagatgttctgttcgcaactggtttgccatgcctaccatgccaacggcgcgcggctccacgccggcaatctggccaaaagcccgatgtcgctgcggcccgaccactgccgccagcttggctggccgcataccacgccggtggcgacgcaatatccgctgccggagctggcgcaaaccgaagtcggcttctacttgataagccgggccgcgctgatcaatgccttgccgatgcgcaagaccctgttttccatccacgcgctgctcactcccggcggccagccgctgacaagtgaacggcacacccatgccagtgaaatcgccggccagatcgacgcgctggaccagcactgggctgcgttgcacctgcccctggaacagaaactgcagcgcctgaccggcatgctggccacggccggcgcatagctggccggcccgtccgcaagaaaggccgcccgcggcggcctgaaagcggatgccccgccagcgcccgcggttagatcagaaagccgtcgtcgaaaaacgacgtgccgtcaaaactcagccggccgttggcaaagatcagatccaggtggtggctgcccagcacgccgccgcccagccccaggtgcaggccgggatggcgctcctcgaagccggcgttcaagccgtacaggcccttcaccccgcaattggtgccgatgccgaactcctccaccgtgcggttgccggcattggccgccaggtatttgtcgaaatcggcggcgaagcgcgcgtcgtcgcaagagaaatccactacctggctggcgcgtatgcggatggaaacgaaatcccgcaccacgccgtatttgacggcaaaggggatggtgctgagaaaggcgccgctgaaacgcacttcgccgtccagatcgcggatggtggtggcgatctcgccgggcgtcaggtcgacattgccgtcgccgtctatcgaagtccaggcctgctccgggccgatggagccagttagccggccgccgtccgcttgttcaaacaccacctgccgcgactccttggccagcgccatcaagcggtggttgcgcgcggcgatgctggcgcgcggctcggcgaacgcctcatgaaagtgcggaccgtagtccttgaacaggatggattttttccagttgtcctgcatggtcttcttgatcggctgcagaaacgccggccccaggtggccaaccgcctgcagcgtggatgagcggtacagaaagatgaacgcatcgcagcgcgctatcgcgtcggcgatgtcgtcgggctgggctgtttccagcggcagcagctgcgcgtcgccgggaaactcggcggcggcgccggccgcgatggcgctggctatgccctggtgaaacccatcgaaacccagcagcaggcgcaccggttcgccagccgcggccttgtccctgaccgcgggatgcaaggccaggcaggcatacatattctgtatgcttcgcatatcatcatcgctagcgcgcatgaacccctccccaaaaacggggccgcccggccccgttctgcaaaatgcggatgaatgccccggcttcagaccggccacagcgccgtgccgaacggcacaaccgccttgtcctgcatcatttcaaccgcttcggcgaaagtttcttcctggaaccaggcatccagttcgatatcctgggtttggatgttttcgatcattttgcatctcctgtgtagttatcaagaaaacacggtcacgccagggcaaacgccccgacaagattacagatgcatatttattgaggaagttcatgaattgatagtattagtaatgctatcaaagcccgcgctttctgacgaaatggaatgacaaatacatcaatctgcctcgcccgcagcccaggcaaaccaaacgcccggacaaagccgggcgtttggttttgatgccggcaagccgcgtcagcttgccttgaccggagcggcttcgccggcaggctgctcgccgggccgctccgccgcctggttgagctcggctcggccgccgctccaatagccggcattggcgatgcccagcctttccgggtggaacaccgggtccagcccttgcgcctgctgcgcttcgtagtctttcaggcaggccagagccggcttgcgcaacaagatgatggcgacgatgttcagccaagccatcagccccacgccgatatcgcccagcccccaggccatgtccgccgtcttcaccgcgccgtacaccgtcgccgccatcaggccgattttcagcgcgaacaccagccncgagctgatgcggctgtatggtgacgagcgcgccgacgaatggaaagccggcgcggcgttctgcacctgctcgaacagcaccaaactggtcaacctgccgccgaccgagaagatgctggccgccaagcgcaccgggccgaagccgccgaatttggcggaggcctacaagttcttcactggccaggatctgctcggcgcgcacaacgccatggtggacgtggccggctgccgcgaggtgtatttcggcatcctgcggcaccgggaggcagcgtgatctaccagacctacggcgaggactaccacgtcacgccgcggcctgagccgctgccggcggcggccggccaggccgatgagccgcgctaccccgacgacggggtggagagcgacgggggcgagctgtaagcccagcaccaacacacgaggcccgcgcgggcctctttctttttgaggatggcatgaatgagttggcacttttcgcgggcgctggtggaggaattcttggcggccacctcctcggatggaacaccgtttgcgccgtcgaatgggagccctacgccgcggctgtacttgcagcccgacagaatgacggccttctcccgcatttcccgatctgggatgacgtgcgcacctttgacggacggccatggcgcggccttgttaacgtggtttctggcggattcccgtgccaggacatcagcgccgccggcgccggcgcaggcatcgacggcgcgcgctcaggcctctggcgtgaaatggcccgaatcatcggcgaggtacgacccagccacgtcctcgtggagaactcaccgctgcttgtgggacgaggccttgccgtggtcatcggtgaccttgccgcgctggggtatgacgcgcagtgggcttgtcttgcggcatccgaccttggagcgccccatcagcgggaccgcatctggcttgtggcaaacgcccgttgcggacgatgcagtgaaccgctcggccgggaagtggaacagccgcggcgagccgaagctgtcggcccaggtgatggtctggcccacgccgaccgcccaggactcgcggcaggccggaggaaaagggtgcatagccaggggcaagagggggctgtcattgcaccaagcaacccagctctggccaactccggtcaggcgggactatcgctccccaggtcgatcctgcctggatcgaaccggcggcaaacaaggggagaacctgccccaatctgtgggtggccagctgaaccccgactgggtcgagtggctaatggggtggcccatagggtggaccgacttaaatcccttgggaacggccaggttccgcgagtggctgcagcagcattcaccatcctgcacgacttctgaggaggacgccgcatgacctgcccctacgaccgctggctgcccgatcagccggcaccaatgcccgaccagggcgaggagtgaaccatgaccaccaagcccgccaccatcaccgccaccatggatggcgacgcagcctaccaattggcgcagttctgcaagcgcgtcaatttcagcacgttctacgagctgaccgaggcgcatttgtcccgcgacgaacgtacccggcgcgcctacctcatggtcgatggactgacggccatcatgaccgggctgaacgaagccggccactccccgcgataggagaccaccatgcaacacctgcacgacatccccgacaccggcgcggcgattgccgcagtcaacgaggccaacgcggccggcgacctcaacctgggcgagcagcccaccagccacatcaacggcgtccacgtctacgaaatgaacgactgcgactgggttgttgcgcgctcggagcaagaggcacaggcctactactgcgacctgaatggcgaagacgatccgccgcgcgcattgactgccgaggagctggatcgattggactttttcgtcgatgccgagaagcccgacggccactcaatcacgttccgtgagcgtctgcagcaactggtagacaacaacgagcaaattcccgacctgttcgccacgacggagtattgaccatgcaacccctgacccaactggcggacgccgcgcgcgccgtcatcgcagctttcgaccgtgccggcgagctgaccgacgaactgatcagtgcgctggagctggcactgaatggagccgagctgtcgccggccaccgagcagagcggcgaggagttggcgtggctggtggtgaatatcgacgaccaggacgagcagtatgttccggcgagcgataagcgccgcatagagcatttccgcgcatctccgggcgcatgggaaatgacgccgctctacacccgccagcagcccgcgccggctgtgctggatgggtggcaatctggcgtggaggcatgcgccaagatgctggagaagaaggctgaagactacgcaagcgagttcggccattcggacatgggcgcgttgtcattcggcagcgggttccatgcagatgtgaagcgcgaccatcattccacactgctggaactggccgaagagctgcgcgccctgctcgccgccgcgccgcagccggcacagcagctgccatccgtgatcgaagagatcgctctgcagtgggacggctgcgaatacgaatcgtcgaccggccaaattgacattggctgggcgatccgcgccgctggccagcgactgctagccgcgccgcagccgagggaaggggccgcgtgatggccgtctacgtagacgacatgcgcgcgcagtatggccggatgatcatgtgccacatgctggccgacaccgacgaggagctgcacgccatggcggcccggatcggtgtggcgcgacggtggcatcagtcggctagcacgccgcacagtcactacgatgtgtgtttggctaaacgcgccgcggccgtcagactcggagcattagagattgaccgcgctggcgtggcgcgtctgatccgacagaagagagaggcattaccgaggtgcacctgcccgtctggcgacggctctctacgctggccgtgcccgcggcatccgccggagtcggcatgatgacccccgcgctaccggccccgccggtctaccgctacacccagcgccgcgacggcgccgtcatctacgttggcccggagccgccggcacaagtaaaagcctagggctgtattgagtggatgcggtaaaggcttccgccgaaggatcgtgacaggtgtagatgtcttatggccagcccatgttctgccagctctttaagtggccaagggcgggaaattatgcgacaaaaatctctcacatcgttgccatttccaagtgtgcctgggagctcttcatccccgatatcggttcggcgcgccagtagaaaatagagctgatcaaatcgaaaatcgaaaatgagcatgccctcctcatcgcgaacggggcttctcatctctatgagatcttgaagcaactcggggtctctttcggacagcaacctcgcaaactcacccttgaaatatgcagcaacacgggcgaggtattttgtctttgtcacggcgcgctccgcagaagaaacattcatcatatcgcaggctctctctaccgtgcttgcgcaggagaaccacatgcaactaatcggcctcgccggcccgaagaaatccggcaaagacaccattgccgaccatctggtcgccaatcacggcttcgtgaagatcggcttcgcggacaagatccgggaggaactgcgcgcggcctaccctggcttggaaacgggtgcattcgaaaatcaagcattcaaagacgtcaatgacatttctcttgctcttgagcattgcgagaacttgggcttcatagactggctgaggcaaagacgcgtagtagagatatacgccgagctgagcgagtcccgctcgcctcgctggctccagcagcaatggggagactaccggcgcgcgaccgccggctgggattatttcatctgcgacgtgcgggcgcgcattgaggcatcaacggcaccggtcgtcgtgtccggcctgcgctacgcagccagcgcgccgatcccgaccgccgaggccggtttgatccggcagctgggcggctgggtttggcacatcaaccgaccaggctatcaggcgtcggccgagcacacgaccgaaatcgccctgccgcgccactcacgcgacctcaccatcgacaatgacggcgacgtcaagaccctgctcgacgtggtcgacctgacagtcggggcgcttgcatgaagcagaactcccctcccatgaagcggccgccctcgctggcggccttgttgtttccgcaggcagtgccggcgagcatgcgcaccctaccctctacactccatgccgagcggcacaacaagggccagtcgttcagtccggcacattggccgcggatgcggtcgtccggcgaaaatatctgaaaaaggaatcgccatgaagtgggtaacactgacaaagtactgcgaagactcaggggacaccaaggatgcggtttacaatcgccgccgtcgcggcacctggctagatggccgtgaatgcaaattggtatcagggaagttgtgggttaacactgaggcggtaaaaaaatggatagaaaacgagggaatgaagtctcacaaggcggcgtagaaacgcgcagcggggcgaaaggatcgtctattcgaatacggttcatgtacaaaggagtcgaatgcagagagactctaaaaattcccgctacaaaagcgaatattgcatatgcctcccgcctaaagggagaaattttaaacgcaattgaaaagggcaccttcaattacgctgactacttcccggacagcaaacgtgcgtcactatttggccacgctatcatcaaatcaaccatgaatgatctattcgactcagcaatttcaggatgggagcaggcagtacaaaatggcacaatgtcaccatcaacgctcgacggatacaaaaagatcgtttccggccgcttacgaccagcaatgggcgaaaaactgttgcgcgacgtcggacctgcattcttgagaacgtggattggagcacttggggttaccgcaaaaacggcgagaaatatcattagccctttgcgctctgtttttgatgatgccatgaatgatggcatgatcgaattcaatccactggatcgagtggctttgcgaaagctgctttctcaaacctcacacaaatctgactattttgtcgacccattttcgattgaggagattgaagcaatcctgaaattcgcatcgggaaacgatgtaaatatgtatcaattttggtttgagactggtttgcggcaaggggagctaattgctttgcgctggtcgaaagtcgatttcatccatggatcagtcaggattgaagaaaacatcgtagtcaaagaggagaaagggccaaaaactgccgcaggtatccgtgacattaccttgacggccaaggcgctggaagccctgcagcggcaaaaggcgatttcgtttctggccggtgatcgagtcttcactcaccacaagaccggcaaggggtgggagacggaaaagcaaatccgaatgagctcctggacacccctgctgaagcgggctggcgtccgctacaggaatccctatcagatccgccacacgttcgcctctcaccacgtcagcaacggtgcgaacctctggtggttagctcgccagctcggccacgagactatcgagatgatcatccggcactacggcaagtgggttccgctggagcgaagaaacgtgggcgaaaattgggcgaacacgacgacagcaggaggcggcaccagacagcaaagaaaaacggcagactagtctaaaagccgcgtccctattggtttgcgaccttctgctattgtctgccgttgccaaaaaactggtggaggcggcgggaatcgaacccgcgtccgaaagtcctctacagtgagttctacatacttagtcgtgtcatttggatttaaccgctgccacgccgacggacaggctggactttggcgagtcacctattatttcgcactgcgccaagtaacccgacacagcactagcagatgtaaagtgacactacagggttttgacgcccccggcccatctgcgaaccgttgtagtgtctagccggccgttaggctgctagagcgtaagtttcgtcgtttgcgactaaaaaaattcagtgttttacggggtgactgaaatcccggtatgcccccatctgcttcgcaacccccgtcgaaaccaggtcgcccccagataagaaagaatattctacaacatttgccatcttttggcgagcattatcccgcgcccggccttatttgctcagcatgtggcccagcttggccgccttggtgtccagataacgatcgttgtagggattgcgccccacttgcagcggcacccgttcggccacgtcgatgccggcggccgccagcgtggccagcttgcgcggattgttggtcatcacccgcacgctgcctatgcccaggtgctccagcatgtggcgggcgatgcggaagtcgcgcatgtcggccgggaagcccagccgctcgttggcctccacggtatccgcgccgccatcctgcagcttgtaggcgcggatcttgttgatcaggccgatgccgcggccttcctggcgcagatacagcagcgcgccgcggccctccttgcagatggcctccatcgccgcctccagctggaaaccgcagtcgcagcgcagcgaaaacagcgcgtcgccggtcaggcattcggaatgcagccgcgccaacaccggctggccgtccgacacgtcgcccagcgtcagcgccacatgctcgcggccgccttcttcttcgaaaccgtgcatgacgaactcgccccagggcgtgggcaattcgcagctggccacatactggatgacgggctctgcggaatctggcaacgggaatgacgacatgacttctccaactcggtgaacgccagcaactggcctgcaatgcaaaaaggccgccacggcggcctggacaaagtttagttggggagcgaatccggtttttcaagcgcaggtagcgcggccagctgcggcgccagcacgatggcgagggccgccagccacacctggcgctccggcgtgaagaagccgggctcgaaagcctcggcgtcgatgatgcccagcacattgtcgtcgccgcccagcaccggcaggcaaacctcgcttttcactttcgggtcgcattcgtagtagccgccgccatcggcgcgccactgcgccacgtcgtcgaccaccaccgcccagccggtcagaccgacgcggctgttgttgctgtattcggcgaaggcttcggtcagcgggaattcggcgcggctctccaccccctggtaagccagcttgaccaggatggcgtccttgccgacgccgatcttgcggtagatgcccagccattcggcgccgaccttggcgttgaccgactccaccagcgcgttgaggttgaccagcgcggcggtcagctccggcgtttcgccacccagcacgaacgacaggtcgtacggggtgtcgtccagctcgttcaccagcgagcagctgccgccctcgcccagcttgggcacccggtagcggtacaggtcgcggcgcggcgcgggcttgtccacgctgaggacggcctgcagcgtgatcacggcgatctgcagctccgtgacatccagattcagcgcctgctctcgcagatagtcggtcagctggcttgcgggtatcatgaggactcctgaacagcggcgcatttgcgatgcgcttcgatttgaaacctaacaggataccaaactccccttcggtccgccatttcagccccttatatcctcatgacagccattcatatccgccacccggcgctcaccatcaaggccggcgccaaagcccggcaaatcctgcaacgcggcctgtcggcgcaacaagtcggcagcctgcccggcgcggccgggggacccaaggcggtggggctgaccgggctggaccaggcggtgttcgaatggctggccggcgcgccgcgcgagcgcgagctggtgggcgcgtcgataggcggctggcgcttcgcctgcgcgatgcagccggacccggcgcgggcgctggcgcgactggccgaacgctataccgaggagggctattccccccgcgtcaccaccgcccagatcaccgcgcagacccgcgccatgctggacgacatcctcggcgcggacggcctcgccaggctgctggaccatccgcattatcggctgagcctgctgctggtgcagtcgcacggcctggccaatagcgaggcgaagccggcgctgttgtccggcctggcggtggcggcggcgctgaacatggtgtcgcggccgctgctgcggcacagcttcagccgggtcatctgccatgatccgcgcagctcgctgcgcttcaagccgacggacgccatccccacccggctgctggcgctggacgccggcaatctgcggcaggcgctgatgggcacggtggccattcccggctttctgcacggcgtgcagctgcccgacgcgccgccggccatctaccgcgacggcggcctcaccgactaccacatcgacttccccttcgccgacggcgaagagatcgcgctatacccgcacttcaccgaccgcatcgtgccgggctggttcgacaaatcgctgccttggcgcaaggccagccgcagcaatcaggccaataccgtgctgatcgcgccgtcgcgcgagtacctggcgcggctgccctccggcaaattgccggaccgcaaggatttccaccgctacctgcggcgggacgcgctgcggcgcgagcactggaaaaccgccagcgcggaaagccagcgcctgggcgacgccttccgcgaatggctggagaagcccggctccatcgcggtgcagccgctttaagccgccggactgccggcgccggcatgaaaaaagccgggcagatgcccggcttcgctgtttgttgatgggtcaagccatcaacccgcctgcgcccagcactgctcttccggcatgtcgcgcggcgtcgcgttcagctccaccaccacgtcgcgggattgcgcgcccttgctgagacgaacggtgatcttgtcggccacgcccggctgatcgaggtcgcggcgatagctgaacgtgccccagtcggaaaccaccgctcggcccagttgcggcgcctgcaccagctggtagcgctcgacgccgcccacgccttcaaactggccgcgcaggcagcgcgccgggccgccgtagctcagcttggccaggttcagctcgccggtttgcggcggctgcggcttggcgctgccggccggacccagcggcccttcgcaacgcagcacggcggtcttgcgcttgaagtcgtagtcggtggccgagcagttggtcgccatcaggttgttgacgccgccagtcttcaccaggctctgcaacgcgccgtccagcagcttgtccagctcctggcgcgcttgggtgttgttcgccgcattcagcggcagcgtgccgttgcactcgaaacggcgcagcgcgctgtccttgccgtctgcccatacctggcaaaccgctggcagcgagcggcgcagcgccgcctccaccgcggcggcgtcgccggcctgccacttatcctgcgccagccagtccgtcccctcctgcgtggaggtattgcccaactggccggacttggccgcctgcacctgctggtccacatactggcggaaaccggacaccagcgcggcgtcgccgcccatgctgttcaccagcgcgtcgaaacgcttgacgtcgtcgacgcgcagcgcggccaggatgtcggcgatcttgcccggctgccgctggttcaggtagtagaaccacagcgcggaatggctgtagaagtcccagccgtcgctataactggaacgcatgatgcgggacggctcgaggaagctgttcggccagccgttcgccaccacgtccaccacgtggccgcgcaccttgatgccgtcgcgcggggtgctccaggccatgaattcggcgaagccttcgtcgtaccatggcatgcggcgatcatcgcggtaaaactccgacgtcccccacatgcccggctggatgaagcggccggacagatagtgcacgtattcgtggcgcaccagttcttccagggtcagatagctctcgcgcggcacttcgcgctggaaggtgtagaaggtgccgtctttctcgatgtagatgccgccgttgtcggtggacagctcgttgagcaggccctggaagcgctggtaggcggtcttggtgccgtagatcaccatccgcagcttggcgttggggtcgtccgccaccggctgcttggtgccggcgacgcggaacagctgggtctgcacctgcttcatcgcgtaatagagcggctccacctcggccaggctcagcggcgtctcgaacaccagattgccgttgtcgaagctccagcggttgggaaacaggctggcacgcaactcctgttcagcctggcagatgccgtagcgttcgcacggcaccttgcccagcttcttcagcgcatacaccgcttcggcccaggcggcgccgaacctctcgcctttcaggtgcaaggcgacggcggcctcggcttgcggcgcggtgcgcgggtattgcatgaagcggccggtttcgcgcagggtgttgaggaacatctgctcgtcggcgaaagccggctggccggcgcgggtcagccctgccaggctggccgccagtccgtcaagctggcccttctccaccttttgggcgaattcgggctggtaatgcatattgaacagcagcgtctgcatcgggtgcagcgcgaaacgcgcccaattgtccttggccgcggcgttgtaacggttgaagaaacgcgtcagcaaaggcagcgcgtagtcggccttgcgcaccgaatcggccaggatcaacgtttccgccacgctctggcgggcgtcgcgctcgcgataccacgcatcgtggtcgccgcggctgtctatcgccttgacctcccacagcgccgggttggccgccagcgcctccaccacctgcatcactggctggtccaccgccgcgccgtagtcgcccacttccttggcatggctgtactgcaggaagtaacccgccttcaggaacaccgccagcggccacaggccattggcgttctgcccgtcccaggcggccgcgcgctggcgcgcctcggccgccaccagctgcatattggccggcgacaccacccggtagctgaaagtgtctgcctggaacaggcggttcatgcaagtgccgtccacgctggccacgtagcgcaccaaggcctggccggacagctggccgagcttggcttcgtcgcaatcggcataggccggcgcggccgcttcggccttcgccgcccggcgggcggcctggccttgctggccttgcggcttggccggcggctgcccggcgccgttatccggcgcggccggcggcaggccgtgcgggtagtccggtttttccggcaaggccggagaatgggaggaatagcgcgccgacggctggttggcttgcggcgcgggctgcttggccgcggcctgatcgccgccgccagtgcccacgcatgccgacagcagcgccgaggccatcacggaaagtcccagggcgcgataccgccccagtgtttttattgtgctcatcgagtcatccatttgctgttaatgacgcatgacttgaaaatcatgcgacgcgaagcataatggatgacgcgtatattgaatattgtgtttaaggtcaggaagtgatcttaaacaataaaaccggtcagttaattttcacagctggaaaaagctaaagtttgcgcaaaaaaagccgcataagcggctttttccagaacaatgcgcccgaggcgtcaatgccgcgcatcgcgcgcgctggccaccacgtcgtaatcgaacaactgggtgacgtcttcctcgtcgaacacatagtgctggttgcaatagtcgcaaacgatctccacactgccctgctccagcagcacgctgcccacttcctcgccgcccaacatggtcagcatgccgccaacccgttcgcgcgagcaattgcagttgaagctgacgctttcctgttcgaacacccgcacttcttcttcatggaacaggcgatgcaggatgtcttcggcgtccagcgtcagcaactcttccgacttcagcgtgcggcccagcacctggatgcgctgccagccctcagcttcgccatggccttccggcaggcgctgcaacagcatgccggcggcggcatcgtcgccgctggccagcaccagcgcggtgtccagctgctcggagcggcgcatgtagttttccagcatttcgccgacggactcgccctccagcgccacgatgccctgccaggtctggttcttgtccaggcgcggctccagcgtcagcacgaaacggccgccgctgcccagcagttcggccagcggcttgccctccagctcgccttcccatttggcggtggcgcgcacggtgcggtcgttgttgcattccaccaccgccagcttcagcgcgccggtgccgtggatctgcaggatcagcgtgccgtcgaacttcagattggcggccatcagcaccgaggccgccatcatttcgccgagaatggtcttcaaggcttgcggataggcgcggcgggacagcacctgctgccaggcgccgtccaggcgcaccagcgcgccgcgcaccggcgcgccgtcgaaaaggaatcgttgcagtttgtcgtgttggttcatgcttttacttccccggccgcgctcgcggccaactctacggtatagacagacatcggcatcgaggagctgacgtcgaattcgcagccggcgcgcacgccgatctcggcgatctccctggcggacaggtcctgatcgtaaaccgcgtacatcgcgcccatcgcgaatttgcggcccgagcctatcgcccagatgcgggagaattcgtagatctcgcgcatcgggtacacgccgaaaatgccgtgggcgttggcgatcaccaccatcatctggctggattcgtacggatcttcctcatcctcctccggacgcagatagaaggcgtccttcagcttgggatgcagcttgcggaaagtgtcgaagatgccttggcggctgctcaggtctttcttcttcagatccttcagcgcgccctgcagcaccaggtcgtgcgcggccgagccggacacagccagatagctgtcgccgtggcggaagatcttgttgtggaagcagtcgtacggcgccagcagcttctggtcgtcgccaaaagtagtctggctatcggcggcgatggcaatctgattgcccttgcgcacagccacgatggttgtcatgcggcacaccctgtcaatgatggagaaaatcgcccatgccggcgatatccgcttgaagatatggccggatggcggattttccaagcccggcgcggcgccgaacccgcaaatataccatagccggcagctgcggcgcagcagcgtggacgcggcggcgcccgatcgaagctaagccgctgtttcctgatgaattttatgcgccgactagaggatcctacttataaacaatcgccttcaacccgcatatgatgtaatggcaaagttcagcccgcccagcgccaagagccagcggcggagaccccttcttcaagaggtgagtgccatgcttgacagcaacttcgacctggatgagccgttggaggccattctgcagcgtcccctgacctggtttgaaaaacagcagattcaggaaaacgaatccgcccctctggaggtcatcgacgccgctgaagccgcaaccgatgctcacccgctacgccgccatctgaaagatctggccaaaatgcaggtcatccacatcgaccgcagccgcgatggccggccgtccctgatcgacatgcccttcaacgccgaagcgttctaagccaggccagttaaccagcgccatgcccccgccccgcgcgggggtttgtcttgatggcaggaagaggcagccctctcccgttccccattccccatttaattcacaaataacaaaaaagatactgtacttaatgcctaattaaatcccgtaaattcggggcgaaaaagcgaacaaatccgtacaaaaaccatcatctccagaacaagccaacttgcccaatcagcagggactgaaacaaaatgtaaataaattgaagatcagcccttaattacaatgaatttgattgcaactggcaaagccttgccgacacaagcggtcagcgccgccagcctcgacctcaaactgggttatcgcagcggccgctgcctgcaaaaaagcggcgtgcacacccgctatttcgccgccgatcatgaaacgcaaagccaattggccgcccgcgcgctgcgcgatgcgctggacaacgccgcgctgcgcgcgtccggcatcgacctgctgatcggcgcctgcggcatccccgagcaggcgctgcccggcaccgccagtttcatatcccacgccgcgggcctgtcggccggcaccgccgccttcgacgtcaacaccagctgcctcagcttcctcagcgccttgcaggtggcggacagcctgctgcgcgccgggtcttaccgccgcatcgccgtcgtctccgccgatctcgcctcgcgcggtctggactgggacaacccggaagcttcgctgattttcggcgacggcgccgccgccgccattctggagcgcggcagcccggcgcagggcctgaaggccttcaagctggccacctatcctgatggccgccattactgcgaaatccgcgccggcggcacccagcgcaatccgcgccgcggcgtagcggaacacgacttcctgttcgacatgaacggcaaggcggtgttcaagctggcatcgaagctgatgccggacttcatcgatcagctgatggccgccacccctggcgggctaggcagcatagactgcgtggtgccgcatcaggccagccacctgggcatgcagcacatggccaagaagttgggcatcgcggcggaccgcatcgtcgacatctacgcctcgcacggcaatcaggtggcggcctcgctgccgaccgcgctgcacgaagcggtcagcagcggccgcgcccgaaacggccagcgcgtgctgatgataggcaccgccgccggcctgaacctgggcggcctggtgtgggatctgtgatgcggattctggtcaccggcgctaccggcggactggggcgcaacgcggtggaaagcctgctggcgcgcggctgccaggtgcgggccaccggccgcaagatggatatcggccggcaattggcccgccagggcgcgcaattcgtcgcgctggacctggccgccgccacgccgggagagctggcggagctgctgcgcggcgtgcaggcggtatggcattgcgccgccttgtcgtcgccatgggggccggaggcggacttcgtcgccgccaacgtaaccgccacccgcaatctgctgcaagccgccggccagtcgcaagccacccgcttcgtccacatttccaccccggcgctgtacttcgatttccgccaccatttcgacattccggaaaactaccgccccgcccgctacgtcaacgcctatgcccgcaccaaggcccaggccgaagaatgggtgcaagcggcggcgcgcgactatccgcggctgcgctgcgccatcctgcggccccgggcgatcttcggcgagcacgaccaagtattgattccgcgcctggcgcgcatcctgcgcgagcgccgcggccgcctgccgctgccgcgcggcggcgcggcgacgctggatctgacctatgtcggcaacgtggtgcacgcgatgtggctggcgacgcagggcccggacatcgccagcggcgaagccttcaacatcaccaaccaacagccggcggcgctgcgcgacatgctgcggcggctgttcatcgacgaactggggcaagacatgcgcatcgtcgacctgccctacccgctgctgaacgccgccagccatctgttgcaatggctggccgccgccagcggccgcgagccggcgctgacgccctatagcctgggcgcggtccagttcgacatgacgctggacaaccgccgcgcccgggaaagactcggctaccagcccatctacagcctggaggacggcgtggcccgcaccgcgcgctggctgcgggagcaggctcatggctaacatccgcgaattcagcgtcggccattgcacccacccatcctgcatggctttgaaaggcagcggcctcgccagccgatgcttcccgtcgcgcgcctacctgattgaaacccgcagccggctatacctgtgggacaccggctacgccgaacatttcatcgacgccacccgccgcggcatctaccggctgtacccgctggtgacgccggtgttcttcaacgccgacgattcgctgcgcggccaattgcggcggatcggcgtcaatcccgacgacatccacgcgctgctgctgtcgcacttccacgccgatcacatcgccggcctgcgcgattttccgcaagcccggctgctggcctcaggcgccggctggcgcgcggtgcgcgggctgacaggactgacggcgctgcgccaggccttcgtgcccgccctgctgccggccgacatcgacagccggctggaatgcgtcgaagcgcagccgcgggtggcgctgccgccggagctggcgccgttcagccacggctgggatgtctccggcgacggcgagattctggtagtggagctgcccggccacgccgtcggccacctgggcgcctttgtccgcaccgaagccggctggacgctgctggcctccgacgccgcctgggccgtcgaaggctacgcgcaattgcgcggcccttccgaactgtcgttcctgattcagcacaaccgccgcgactactaccagacgctgggcaaattgcatgctcttcaccgccgcggacaggtggacatccgcctgacgcaccaggaagccaactgatccatgcttcgcctcttccgcattttgcgcgcctaccggcgcacccgcggcctgcgcttcgccgaccgcgccgcgctggcgcgccatcaaagccggcaactggcgacgttccgcgcccgcctgcagcgccgcagcccctatttcgccgacctgggcgagctgccgttcgcgcaatggccattgatggacaaagccgccatgctccgccacttcaaccggatgaacgccgccggcctgacgctggagcaggtgatgcgcgccgcgcagcaggcggagcgcagccgcgatttctcgccgaccataggccgctacacagtgggcctgtcgtccggcaccaccgcgcagcgcggcgccttcgtcgtcagccgcgccgaacaggcgcaatgggccggcgtcatgctggccaaagccttgccggacggcctgttcgcccgcgagcgggtggcgctgttcctgcgcgccaacagcaatctgtacaccgcggtgcgcagccgctggctcaccttcgaatttttcgacctgttccagcccttcgccagccagctgtcccggctggccggctaccgtcccaccattctgctggccccggcccaagtgctgcgcgcgctggcgcaggcccaattggccggccagctgcaattggcgccgaagcgggtttattcgatcgccgaggtgctggaaacccaggatcgcgccatcattgaaaaagctttcggccaggtccaccaaatctaccaggccactgaaggctttctcgccagcagctgcgagcacggcgtgctgcatctgaacgaggaatacatccatgtcgagccggaatggctggacgaggagcggcgccgcttcgtgcccatcatcaccgacttcagccgccacacccagcccatcgtccgctaccggctgaacgacgtgctgctggcgcgcgccgctccctgcccatgcggccgcgccacgctggcgctggacggcgtggaaggccgctgcgacgatatgctgctgctgcccgaccgcgccggccggcagcagaccgtgttcgccgatgtgctcagccgcgcgctggcgcaagccttgccctgggatgccgattaccggctgcgtcaaaccggcccgcgcgcgctgacgctgcacctggagttggacgatgccggcgccggcgcggtccggcagcggctggagcagaccctcgccgggctgggggtggatgtcgccgcgctggaatggcggctggagggcgcgctgccgccgctcgaccccacccgcaagcgccggcgcatcatccgggaggcggcatgatgctagccttgtcctggctgccgccccggctgcgccacatgctgctgggctggggggcggtgggctgcgcctacacgctgggcagcgtctggcccggcgcgccgcggctgctgccggagtggccgaccgaccgctggatagcgttcgacccggccgccatctggctgtacctgtcgtttttcttgctggtgccagcgggctttctgttggcgccgcctgacaggctgccctggctgcggcgttcgatgcagctgtgcgcgctggccgccggcgcgaccttcctgctgctgccgaccacgctgccctacccggccgtcgccggcggcggctttcacgccgaactgctgcgcgccgccctgcgcttcgatacgccgcacaactgcctgccctcgctgcacggtgcgctgaccgtgctggcggcatgggcgctgtcggagcggcgccggccctggcgcgctgtgctggcctggctgtgggccgccgccatcctgttcgctgtgatacagctgcgccgccacctcaccttggacctgggcgccggcgtcgcgctgggcctgctgtgcggctggctgtgcgcgcgtcccgcattcctcttttctttccgctatcgcaccacatgaacgtattcgccctcaccttcatcctgatgctcgccgtggttctgctggagctgcttgccttgcgcctatggcgccgcgaagccattccctggcgcgagatcatcttcaacctcaactccggccacatcctgatgtgggtcttccgcggcgtggaggtggccagcttcggctggctgcttgaacacgccaacctgcacctggtggaccggctgccggcgctctggcaatgggttttcgccttcatcgcctgggatctgagcttttactgcatgcaccgggcccaccacacctggcgcattttctgggcggtgcacgttgtccaccaccagggcgagcatttcagcctgtcgctgggcatccgcaattcctggtattcgtcgctgacttcgctgctgttcgtcgcgccgctggcggtgctggggctgccgctggagatgttcgtcgccgcgtcgtccttccattacgcggtgcagctgtacaaccataatgctttcgtcggcaagtccggctggctggaccgcgtgctggtgacgccgtccaaccaccgcgtgcatcacgccaccgaccccatctacctgaacaagaacttcggcggcaccttcctgatctgggacaagctgttcggcagctatcaagccgaacgcgacgatgtgccgctgcgctacggcgtgcgcggcgagtcgcccggctacaatccgctgtgggccagtaatcccggcttgctggcgctggtccgccgccgctttcccgcgtggcttgcgcgcgcgcgcatggacgtgccggccggctatatcgccagcggcggcgtgctgctgttcggcgtggtgatctattacgtgcaaaacgtggcggaatggtcggcgccgcagcaatggacgctgttcggctacctgctggccggcaccctcgccatcggcgggatgtccgaccgccagcgctggggctggcgcggctggcaggcgctggtgctgaccctgcccgtcctgtgcgccggctggctgggcatgcgcgacctgtgcgcgctggcgctgttcgcgctgctgctgggccatggactgctgggctggcgcctgaaggaggccgcatgagcaaattgcgttttcaatcgtcggccgagctgccgttccgcatcgagctgcaacaggcggcgcaagcctatctggagcaaagccgcgaccaccgcttcgccagcgccggcatctggctcaaggcctggctgctggccggcctgagcctggcctgctatctgctggcgttgcgcgccgacgcgctgtggcagttcgccccggcctatgtcgccgctatcctgctggccatgctgctggcgatgaacagcctgcacgacgccgcccacggcgcggtgttccgccgcccctggctcaaccggctgctgagccgcgtcgccagcctgccgatgggcatagactccgatatctggatccgccgccacgtgcatctgcaccatacctatcccaatgtcgacggctacgatctggacatcgaacccaatcccttcctgcgccagacgccgtttcaggactgggcgccgcaattccgccatcagcaccgctattggccgctgatcgccgcgctgtcgctgccctatctgtgctggtacggcgactggctggacctgatgggcaagagcaagctgcagctgcgcgacgccaagccggtgcgcgctccgggctttctgctggccaaggccggccacctggcgctggcgctgggcctgccgatctggctgctgcacgacggcggcatcggctggggcagcgtgctgctgtgctatctgctgggccaaatggccgcatcctgcttcctggtggcgatgatactcggcacccactgggccgacgtggcgtttttccagcccggcgccgacggcaagctgccgcacacctggcacgagcatcaattcctcacctgttgcgactgggagccgcggccgcgcgcgctggcccatctgctgggcggtctgcacctgcacctgacccatcacctgttcccgtcctacagccaccgccattatccggcgctggcccgcatcacccggcaggtggcgcaaaagcacggcctggattaccgctgcttggactaccccgagctgtggcaggcgcagcagcgcttcctcaagtccatggggagccggccgcagccatgaaaaaggccggcggccgcatgccagcggccgccggcccggttctcccccgccttacagcggcccgtacaccgtgccctggttctggtccaccctgtcccgcacccagaagcgccagccgttggcctggccgtattcgccgacgatgttcaccccctgctggctgttgtattggccggccgggatgttattgacccccgacgggctgatatgcagcagataggccggcttcagcgccaccacctccgccagccgcgccgcgtagcgcgtcgggtcgccgatgaagttgttgtgctcgacggtgatgtgctgcctgtccggcccgtaggccagaaactggcagccgttcatgccgtcggtgaacatgtaataccttgccggctgctgggtgggcagcacgaacagattgatgttgttggccaccggatgcgcgtaaaaaccggggatgttcgggctggcggcggtggactgcagcaccgccgcgtgcgcgccctgcgccgcgaactggtatttgccgttgccgggcggaacctgcgccggaatcaatatcgcctgagaacgcatgaaagcctgcgggttctccagaaaatcggtagtcaaagacatgccattcctttccgttttacgatgccgggattatttgtgacccggccgcttgccgatcggtttccctgccggcgcggccgatttgtaaatccggcgcgccccttgctggcgccggcgtccaaaccttaaacacctgtttaaattgcggcaacggtaacaaaggccagtctgctgcccactaccgggccgccgcctgcgcgcctagcaggcggcgcgactgcgccagcaacaccccgcccaccagcaggcccagcaacagattgaccagcggcatcgccagccataccccgtccacgcccagccacaggggcatcagccccagcgtcggcagcaacagcaaggtcttgctgatggtgatgccgagagccagccgcgtcagcgccatcgcctgcagcgcggtgcagcccaccaccaccaggccgtccaacggcatcgccagcagatgcaggcgcagcgcatggctgccggccgccaccaaatcttggctgccgtcgctgtaccagccggcgatccaggccggaaacagctgcaccgccgccagcgccgccaagcccagcgccaatccccccctgacgccgtgcagcagcgcctcgcgcgcccggcccggctggccggcgccggtggcgtggcccagcagcggctgcatgcccaccgccaggccgtggatcgccagcgtgaacagcgcttcggtgtagcctgccaccgcgtaggccgccacgctcaggtcgtcgccccagcgcagcagctggtggttgtgcgcgtacagcagcaaggcgagattcagctccatcagcaggctgggcgcgcccagcgccaggatgggccacagcgcggccttgtccagccgcatattgccgacgcgcagccgcaccgcggcatggcgcgtgaagaaatagcccaggcccagcgccaccaccaccgattcggccagcagcgtgcctatcgccgagccggccagccccaggcccagcccgcccaccagcaggaaattcagcgggatgttcaatagcgcgcccaggatggtcagcgcggtggccaggcccgggcggccatcgttgcgcaccagataggtgaccagcatctgccccatggtcagcgccgcgccggccagcatccaccacagataggcgcgcgcctgcgccgccacttcaggctggccgtcggcctgcagccattccagcagcttgccgacgttgggcagccccgccagcggaatcgccgcgcccagcaaggccagcagcgccagggccgccagcagcgtgccgcgcgcgccggcgacatcgccggccccctgccggatcgcgatgcgggtggccgcgcccatgctgaccatcgcgcccaggcccacctgcagcatcaccagcgggtaggccagattgatggcggccaggccgtggctgccgacatagtggccgacgaacacgccgtccacgatggcgtacaggccggtgacgaccatgccggcgacggaggggatggcgtagcgccagaacaatgtggacaccggcaaggtgtccaggtctcgggtatgcgagtgagccacggggaactgcctgatggataaaacggcgattctaacatttaatcagtcatgcatgattaattaatttcccgcacaatggcggcaagcaaaaagaaatggacgactcgcatggcccgcaaaaccaaggaagattcgcagaaaacccgcgacgccattctggacggcgccgaacaggcttttctggccaagggcatcgccaacgccaccatggccgacatcgccgaagccgccggcgtgtcgcgcggcgcggtctacggccactacgacaacaagctgctggtatgccaggcgatgatagaccgcgccttcgcgctggacgcgctggacttcccctcccagcgcgaatcggcttgcgacaccctgctggcggccagcctctactacctggcccagttcctggagccgggctcgccgcagcgggtattcgaaatcctttacctcaagtgcgagcgcagcgaggaaaaccgcagcgtgctgcgccggcgcgagatgatggaccggctgacgctgcactacacccgccgccagctgcgccgcgccatcgccggccgcgaactgccggccaccctggacgtgggcctggccgccgactacctggtgtacctgttcctgggcctttacgacctgctggaaaccgggccggcggcgctgccgcgctgcgaacgcatcctgcgcggcgcgctggaagccctgccgcacgcggccagcctgcagcgccagccctgacggctattcgacatggcggcggaaacgccacagcgccagcgccagcgtggccagcgcgatcagccacagcggcagcagccacggccaggcgtcggcgaaaccataacccttgaggaaagtccccttgagaatgggaatgaagtaactgagcggattgagccgcgccagccattgcagcgccagcggcatgttctcgatcggcgacacgtagccggacaggatcaccgccggcaccatgaaggaaaacaccccgaggaaggcctgctgctgggtatgggaaatcgacgagatgaacagccccaccccggccagcgccaggccgtagctggccatgctggccaagagcagcggcaatgaaccgccgaacggcacccggtacgcccacgccgccgccgcggcgatcaggctgccctgcagcaaggccaccagcacccccggcagcgccttgccggccatgatgtaggccggcgtcagcggcgacaccagcagctggtcgaaggtgccctcttcgcgctcgcgcgccaccgacagcgcggtgacgatcaggcagcctatggtggtgatgatagccaccaggctgggcagcacgtgccactggaactccaggttcgggttgtacagattgcgcaccaccacgccgccggccgcgccgcccgccctctcctgcgcgtaatccgccgccacctggccgacgtaagcgccggcaatctgcccgctgttggagcgccgcccgtccacgatcacctgcagcggcgcggcgcgccccgccgccagatcgcgcgagaaatcggccgggaacaccaccgccagaagcgcgtcctgccggtctatcgccgcccgcagccccgcctggctggccactggcaccacccggtcgaaagtcgcgctggccgacaagcgcttgatcaactccagcgaggccgcgccgccgtcctggttgtacaccgccaggctggcgtgcttgacctccagcgtggcggcgaacggaaacaccagcagctgcagcagcaccggcaccaccagcaacaggcggccctggcggctgccggcgacggcctgaagctccttgatgatcagccacagcaagcgacgccacatggcttcagtccagggtccggcgggttttgcgcacggtctggcccagccagaaggcgccgagcaggatcaggctggcggcattgaaccacagcagcgacgggatcaccccggcctggaacaacgtctgcagcgtgctggcgaaatagcgcgccggcaggatgcgcgtcagccattgcaggggcgccggcatgctggagatttcaaacacgaagcccgacagcatcagcgccggcaggtagccggcggtcagcgccgcctgcgccgcgtcgaactggcttttcagcgtggtagacaaaaacagccccatgcccagcgcattggccagaaacagcgaggacatcagccacagcagccacagcgggccgcggaacggcacccccatgacgaacaccgccaccagcaggcacagcagcatggcggcgatgcccagcgcgtagtaaggcaggattttggacaggatcagctccgcccggctcaccggcgtggccagcagcgcctccatggtgccgcgctcccattcgcgcgccaccaccagcgaggacagcagcgcgccgacgatggtcatcacgatggcgatggtgcccggcaccagaaagttggggctttcggcgctggggttgaaccagacgcgctggcggatatcgatggccgccggcggcggcagctcccgctgctcggcctcggactgccgccattgcagccacaccccctgcgcgtaggcggcgacgaaattggcggtattgggttcggcgccgtcggccagcagctggatggcggcgccggcgccgcggcgggagaaatcatcggggatcaccaccgcgccgcgtatctcgccatgcgccagttgctcttccagctgcgcgcgcgaaaccatcgggtgcacctcgaacgacggcgagccgtaaaaggcggccgccaaacgcgccgctgccgcgccgccatcctggttcagcaggcccagccggatatgggctgaatccagattcaccgcatagcccaggatgaacagcagcgccaccggcaggatgaaggcgatcaggatgctgctcggatcgcggacgatctgaaagctctccttgcggcacagcgccagcagccggcgcagcttcagtccgcgcatcggtcggcctcctccaccagctggatgaaggcgtcttccatggtgggattgggccgcgccgcgctcgccaccccgcttttgagcgcgtccggggtgtccagcgccagcagcttgccgcggtagatcagcgcgatgcggtcgcagtattccgcctcgtccatgaagtgggtggtcaccagcacggtgacgcccttgtcggccagcccgttgatatgggtccagaactcgcgccgcgtcaccgggtccacgccggaagtcggctcgtccaggaacaacagcggcggctcgtgcatcaccgcgcaggccagcgccagccgctgcttgaagcccagcggcagcgtggccgccgggccgtccagatacggctccaggccgaacacccgcgccatctgcgccaccttggcgcgctgcgcctggcccgccaggccgtagacgccggagaagaacatcaggttgcgccgcaccgacagctgcgcgtacagggaaaacttctgcgccatatagcccagctgctggcgggcggcgctggggctggtcttcaggtccatgcccatcaccagcgcctggccggcgctgggcttcaataacccgcactccatcttgaaagtcgtcgacttgccggcgccgttggggcccagcaagccgaacacctcgccgcgccgcaccgcgaagctgacattgtcggtggcgcgaaaatcgccgaagcgcttggtcagcgccctggcctctatcaccgcctccgcgccgcgcgccggcaccgccggcatcacttccgccagcaccgaatcgccgcccggcccgccgcccagcaggctgatgaaggcgtcctccagccgcggcggcgccggctccagccgcgcgtccggcccggcttccgcctgcgccagatccggccattcgccctcatgccgcagcagcagccgcaggctgccgccctggatggcgccgtccatcagctgcggctggcgcaacagcctttgcagcaagcggcggcgattgccggcgatgccggacagtttcagacagcgcccggccagcggacgcgtcagctcggccggcggcccggcggcgcggatgcgtccctggtccatcaggtaaaccgcgtcgcagccttcggcctcgtccagataggcggtgctgagcagcacggtgatgccgtcggccgacagcgcgcggatcagcttccacaattcgcgccgcgagatcggatccacccccacgcccggctcgtccagcagcagcacccgcggcctccccagcagcgagcaggccaaacccagcttctgcttcatgccgccggacagcttgccggcgtggcggccggtgaacggcgccagatcggtcagcgccagcagccgttcgaaatctttttcccgctccgcgcccgtcacatcgcgcaggtcggagtacaggtcgaggttctcgcgcaccgtcaggtcttcgtacaggccgaacttctgcggcatgtagccgacctcgcggcgcagcctctccccatccgcctgcgggtccagccccgccacccgcgccgcgcccaggctgggcgccagcagaccggccagaatccgcagcaaggtggttttgcccgcgccgtccggccccaccaggccggcgacgcagccggcgggaatcgacagttcgacatcggccagcgcgtcgcgctcggcgccgggaaaacgcttcgccaggccttgcgtcagaatggccggcacggcgctcatggcgccagcctcaccgtgaccggcatgccctggttgaggccggcgtcggcgtcgctcaccacgatgcggatgcggtagaccagcgaggtgcgcagatcggcggtttccaccgatttcggcgtgaattcggcggtgggcgacacgaagcccaccacgccgtgataggtcttgtccggatggctgtcggtgctcagcagcaccttgccgccgctgggaaagcggcccaactgggcctcgccgacataggcgcgcacccacaccggctggcgcagcgacaagctgaaggccggcgcgcccgcctgcaccatgctgccggcctccaccgcccgggtcaggatgatgccggcgctgggcgcctgcagattggcgtcgcgcaacgccagcctggcggcggccaggtcggcgcgcgcctgtttcagttgggcatcggattcggcaatctcttccggacggtagcccctggccagcgcctgccattgctgcgcggccgcgtcgcgctgcgccagcgcctggtcgcgctgcgagcgggcggcctccagcgactgctggctgctgccgccggccggcaccaaatcgcgctggcggcggtactcgctttgcgcctgcgtcagcgcggccgcggcggcctccagccgggctttggcctgggcgatgtcctcgccgcggttgcctttgtggatcaaggcgttgcgcgcggccagcgccgcctcattggccagcgccgcgttcagactgttgcgcagcggctcggcgtccagccgcgccaatatctgccccggctgcacgctgtcgccctcgtccacctgcaccgcggccaggcggccggatacgcggaaagccaggctgagctcgcggatgtcgacattgccgtacaaagtggcgttccgctccgcgccggccgagcgttgataggcgtaatagccggtgccagaagctgccagcgccagcgccgcaaatgcgaccccgatcttcctcatcccgcctcccccgcttcgccatgcccggcgccatgtcatttttatacgcccgcgcggatgcagcggcaatgcaatggatcaaacttcggcaggagagcgcccgcgcaggcgggccggggcggctatcgcgcgggtgcgctcagagcgttttgcacatcaggaagccggcgccgaaccacaaacccaccaccatcagaggctcggccatcttgccgcgcagcagcatcaacggcgcgcggaaacggacgcggatgggccacagcagcgggatgccggccggcgtcagccagtcgccggccaaatgcgaggcatagccgacgcagatgcccagcaccacgggcatcgcgtgccccagcttgacatgccagccgtgcaggcaggcggcgcaggcgtagaacacgccggccaccgccagcaggctgtgggtgatgccgcggtggccgaacagataggccaccgggcgcgaaagaaagggaatgcgccggcccagccagcttttggggtggtcgatgtccggcaatagcgaacctgccaggccgccggccaacagcaacagcgccatcaacggcggaaaatgcagcaacaaggcggtggacaccgcgcaaaacgcgccaaacgcaacatgtgtggcgaccatcatccggctatcccgccgctttccctgctgaccatcgtgctgcccctgcggcatattgttaccgtgctaccgaccgctcatgccgccatcgccacccgcgcgtccgccgccatggatttcagaccgagggcggacagcgggcgccatgctactgcatcgcgcgccggatgcaaagaaaacttgccatctgtgaaagtaaaagcctgatcttatgccgacgcgctgccggatttgcgctgatggctgtcagtatccgccggcgtccaagacgcccacggcctcaacagacaaggaatttgccgtttagtgccgcggcgccggccggcggaaagcgttatagaatgaaacggccagcagcgcgcccgccggcgccgggcgccagccggacccgccatccgccgacaacgaggaccccatgccgcgacgcccgcccagaatccttcgcccgctctgcctggccgccatcgcgccgctgctcgcggccgggccgctgcgggcggaaaccatgacctgggtgctgtccgactggccgcccaacttcatcgtgcgcgaaggcaagcccaccatcgggcagaacgatgtctatctgcggctgatcatcgaacgctggccgcaggtgcagcaccgcttcgtcgtgatgagcaccgcgcgcagcatactggagctgcagaacaagacccgcctgtgccggcccaacctgatccccaccccggagcggcagcgattcgcctatttcacgctgacccatatgcagctgccgctgcagctgatcatccgccgcgacctggcggccaaggcgccgctgaacgccaagggcgaagtggagctggccaggctgatccgccagccggggctgcgcggcatcgtcgccgccggccgcagctacaccgccgcgatcgacagcgtgctggccgccgcgaaaaccggctccaacatccgcgcgctgcaaaacctgcccgccaacgagggcctgttcaagctgctggcgctgggccgcgccgactacacgctggattacgagcccaatctcgaataccacaatcggcacaaccgcgaccagacgctagccggcctgccgatagccggcgccgcgctgattccggtcggcatcgcctgtccgcgcaccgaatgggggctgcaggccatccgcaagatcgacgcgctgctcgcccaggcagtcgccgaccccgcttatcgcgccgcgcaggccagctgggcatcgccggcctccttgcagcgctacaaggccgggctggaccgcttctaccagcagcgcagccatcccgcgcccgcagcggaattcgcgccgccgctgcggccttgagcccatacaaagacaatgccggaggatcgctcccccggcatcgttcatctccccgcgcggccttgcggcctacacctggaactgcgccaccgactgcctgaggctgccagtcacctcgtctatccgctgtatgctctccgacgcctgggtggctgccaccgcgttgccggaagccacctgggcgatctgctcgacgtggcgggcgatgtcctggctggcggtgccctgctcctgcagcgcgtgcgagatgtcgttgaccacccgcaccacctggctcgcgctgccgtggatctgctggatcagctggccgccttgctcggccagctccaggccggttctcaccttggtcactgtctcgctcatgttctgccgcgacaggtccgagctgacctggatttcggtgatcatcgtcgcagtctgctcggtggccttggcggtgcgctcggacaattttcgcacctcgtccgccaccaccgcgaagccgcggccgctctcgccggcgcgcgccgcctctatcgccgcgttcaaggccaaaagattggtctggtcggcgatgtccttgatcacctgcatgatgttggagatggtggcggtcttgctggccaggtcggcgatcgccgcttccgtcatgtccaccgtggcgctgatgccctgcatctcctccaccgcgcgcgcgatcacctcgctgccggtttccgacagctggcccgagtcctgcgacaccgagcgggcatccttggcgtgctgggcgatgtggttgatgctgaccgtcagttgctccaccgaggccgccatcgccgccgcgccttcgctctgcccctgcgagttgtccgccaccatcttggcgccgtcgaccacatcggcgttcagccggcccagctcctcggcatcgcgcatgatttcccccaccaactggcgcagttgcgcctgcatctcgcggatatgcgccagcaggctgtcgccgtcgccggcctccagccgtatctcgcggtccagcttgccggcggcgatctcgcgcacgatggcggccgcctcggacggctcggcgcccaactcgcgcatcacgctgcgatacacccaccagcccaaagacaggctcaccgccatgaacagcagcacctgggcgcccacgcccagcagctggcgcagcagcaccgtgttgatgtcgtcgagatacaggccggtgcccactacccagccccagcgggcggtggtctggaaatacgcgagcttgggctgcggcgcgctggtgcccggcttgtcccagtaatactcggcgaagcccttgccgccgttttccctcagcacgccgtcgaacaactggcccatgctggtgccggccgcgtccttcactccgtgcatgtccctgccgaccagcttgggattcatgccatgggccagccacaccatattgcggtccagcgtgaagaaatactcgcggccgtcgaaacgcagcttgctcagctccagcaaagcctgccgcttggcgtccgcttccggcaccaggcccttttccgccatttcctcatgcgcggccaccaggctggcggccgcctccacctggccgcgtacctgatcgtggcggtcggacagcatttgctggcgcaaagcgttcatcagcaacgcgcccaatacgcataccaatacgatggtgctggcggtctgcagcagcaatcgtcgcttcaatgaaatggttttcgccattgccccatccgatgatttgtaaacagctggcaacgatagcgcattcaattattcattttcaatatcaatatccaatttattgacttttgtcatgccatgccgccgaaaaatctgccggatggtcggcgcggcatgcttcttcttgacttttatatcttaagacatatatcttaagatagttatctcttgcaggagccgccatgcgcttctttcgccacgactccggccgccattgcggcggccgccgccacgcccatcacgccggcgacagcgaacacctgtcgcgcggccgcaaattcagctccgacgacctgcaattgctgttgctggcgctgatagccgagcgcccaagccacggctacgaactgatcaaggcgctggccagccgctccaacggctattacagccccagcccgggcatggtctatcccgccctcacctatctggaggaaatcggccatgtcaccgtggcgagcagcggcaaccgcaagtgctattcgatcgcagaacccggccgcctgcacctggcagtcaaccgcgaacatgtggagcggatgctggccaagctggagcacatcggccgcaagatggagctggcccgccgcgcctacgccggcgaggaaatcggcgaagaaggcgcggccggctgggtccgggagctgatagaggcccgccgcgcgctcaagcacgcgctgctgctgcgcgacaaggccgacgccgacgagcaacgccgcatcgccgacatcctgcaacgcgccactgccgagatcatcggccaaaattaataaaggaccacccatgcgccacgatctgaccatacaaaaactgcgccacccgctgcaattccgcttgctgcgggttagccgcatagagcggctcgccgggcgcctgctgcgcgtcaccttgagcggcgccgacctggagggcttcgcctcctcctcattcgacgaccacgtcaagctgttcttccccgcgcccggcgagatccggcccgtcagcccctccgtcggcgagggcggcatcgtcttcccggccgaccaagccaagcctgcgatgcgcgactacacgccgcgccgttacgccgccgacgccggcgagctggacatagacttcgtgctgcacgaaggcggcgtcgcctccgactgggccgcccaagcccaggtcggccactatctgggcgtaggcggaccgcgcggctcgcgcgtggtgccgacgggattcgactggcactggctgattggcgacgaaacggcgctgccggcgatcagccgccggctggaagagctgccggccgacagccgcggcgccgccgtcatcctggtagacaacgccgatgcccgcctgccccttggcggcccagccggcatggaaatcatctggcgccagcgcgaccggcgacaagacctgctgcagacggtgacggaaatgcccctgccgggcggcgatggatatgtctgggccgcaggggaaagcggcgaaatgcgcgccgtgcataaacatctgcagctgcgcggcgtggacaaggacaggatgcgtgtggccggctactggaaacgcggcgacgccggcgcgcatgaaaccataggcgaataagagcaaacccgtcgcagcaggccaggccgcccgcctgcctgcctgcggacgcatgcatcgcgcaacagcggcccctggatggatgccggcgatcatcaccccatccatcactcaatcgatcatcacgccatgccgaaaaaccatcgtcattttgaaaacataatcgcggtaaaacatttttataactgcataaaagcgttcatatactgattttctccatctcagcgcccaacaatcccccgccatcgccattctctgcagccggcttaaaatccgcagtccaaaacgaatacctgcatgaaagcccggcgcgccaggctttccaatgccatcccccagtaaaaatacttattcatatcatccgataaaaaatattgcggcataaaggtatatcaaaaaaatcttgcattttgggtaagcatttctacgctgaaaaatcgcataccggctgttgagtcttcagaatgttggttgattagcaaaggatattgacatggaaatgttcgatatacggcaacctctgtcgcgacaccatctggaccagcgctttccctcttgcctgcacgttcccgccggcgttcaggaaacccggatcgagcctggctgcaccgcgtacggcttcgtgcagcagggacagatgctcgtctcccatgccggcctcaaccagatgctgcacgccggcatgttcttctcgattcccggccccgccctgctcagccccttcgtcggcctggtcggcatccgccaggactatcacggcgcgccgctgtacggcggcccgatagaacggctgggccggctgaaatacatcgacggttgctccgacagcctgctgatttcgccgatgatcaagggcgacccctgcctcaactatctttacgtgccaccgcatctgcaccaaaccgcccacacccacccatcggtgcgcatcggcatcatcatcgaaggcgaaggctactgtctgaccgaacacgagcgcctggaactggttgccggcaagatcttcgtgttgccggccgacgaaatccatagcttccacaccgagcacagcccgctgcgcatcgtgatctatcacccggattccgacttcggccccacccacgaagaacatccgatgatcaaccgcaccctggtggatggcgtctccctggccggcgacaacccttaccgcaccagcaaaatcgccgaatacgtagccaactgagcgccccatgccaagagacgttcacccaggcccgccctgcccccagcttggcgccgacgcgctgtccggcgcgttgccgccgctgcctgcctggctggcagaccccagaccagccgcgccgcgcctgccgtggccgccgcgcccggacaggcgggaccccggcctgagccagggcgagttcgcccgcctgctcaagcacgccggcgtttgcgatctcggcgccgtgccggtgccgggcgcctgcgtgctgctgccgtggggggtggcgctgagcgaaaggctggcggggctgctgcgcgccgccctcgacgatctgggactggacgaatacgcctatccgcacgtggtgccgcaggaatgtttcgagccgatggccgatttgctcgatgccgaacgctgcctgttgcaggtcgccaccggccacgaccgcgaacgcaaccgcctgcgcggcgtgctgacgcccaccggcgaacaggtgatcgccagccactggcggcagctggtcacccaggccgaggcgctgcctatccgcatgttccagcgcgcgcgctacttccgcccggtcagttcggccgaccgcagcggcaaaggggtgttcgccgcgctggaggcggccgacgtcttcgaattccactgctgccacgccgccatggaagaggcgcagggcgacctgcaacggctgcacctagggctggaacggctggcagaatcgctttgcctgccgcaatttgtcggcgtgcgcccgccctggggcaaccgcgaagccctgtacgaatgggcgctgggcggcgacaccccgttgcccagcggcgaatgcgtgcagacttcggcgctgtatttccaaggccagcgcttgtccagccgctacgacatcggcctgggcaaaggcgagcggcggcggcacgcctggcagctggacggcttcgccagccgcaggatgctgtacgcccagctatgcctgtcggccaaggccgatggctccctgacggtgcacccgcagctggcggcgacccaggtggccatcctggcgcgcagccaggatgaagacgaacggcgctttctggagacgctgcgggaacaactgaaggcctgcggcctgcgtccggctctggagcgctgcgccgatgcccggacgctgacttcgcggatgcggcaatggcggcaccgcggcgcgccgctgctgctgctgtatttcggccgccgccacgcgcaagaccaacccaggctgcgcctgtaccgcaccgatgccgacctcgagctggaagccgctgcggactgcgcagcggaggcgctggcgcagcagctggcggacgcgctggccgacgtagaagccgacgcgggcgccgatgtcctgcggcgcgcccgcagccagatcgccttcgccggctcggaggccgaagccaagcaggcgttggcggcgcgcaagagcgtgatcgcgcccgtcagcccgacccgccgccacgcggaggccgcggcggcgtggcaaatgggagagctgtgcagtttcgcggcggcggacgaacccgccccatgcattttctcaggccgaccgacctgggcgcgcgccctgctgtcgcgacgcatctgacccctatcttgagcaaaggagaagacatgacaagcagccatgcagaccagctggaaatgatagtcgggccggtgcgcctgccgctgaagatcgacgacagcgtcaactacttccagctgcactacttcgaattccagggcaagcgctgggcctgcgcggcgcttggcgatctcgccgcgcaggaagcggtgccgctgcgcatagaatcggcgtgctttttcggccacgtgatgcattcgcagcagtgcgactgcggcttccagctggacgaagccttccgccgcatctcgcagcgccagggcgggctggtgatctacggcatagaccaggatgcccgcggcctgggaatagaaaagcatttccgcatctacgactaccggcagaaccaccaactggacaccgatgaagtctaccagcgcttccatgccccgctggatagccgctcctacgaggcggtggccgccatcctgcgcttcctcaaggtggaaagcatcctgctgatgtcgaacaaccgcgcgcggctggagtttctgcgcgaacagggcttccgggtggagcgcgaccagatcgaggcgccgctgacccgctacaacatggccaccatgatgctggagaaggaagacctggcctaccaatggagcttccagacccacggcgactggctgcggccgctgcaggaccaggcggaggcgcatcccgaccgccgcgccgcgcgcatcgtccgcgacaaccagcaggtggtggcggaatggcagggagacagctgggacgtggcccgccatctgctggctgggctggcccagcaaccggcaggcgagctggtgatctacctcagcgatctgcccagactggacgaactggcggcctacgccgccaccggcgcccgcttcgtggtggtgcctttcgccaccctgccaggctatctggaaacggaagcccgccagctcggcatcaagctgcaggactggggccgtgaaaacaagtacgcgcagcctcggccgcaatggcaactggaggaccagaccggcgacagccacgtctatcgccgcggcgatgaaagacggacctgccgccgggacggcgcggcggatgccgtagcctgagtcgccgccatgccccatctggccctctccacctccaggcaggccgcgctggccgccatgcaggacgacgcctccgactgcctgatggtggacagcttcaacggcgcgcccgccaatatgcgcggcttccgctgcttcaatcccttccaactctggcccgatcccgtcatcccggtgccggggcaggccggacggctggcgcgatcggtcgaatcggtgtggcagggcttgaagctggtggacgggcgcaccgacttcgagcagtttctggccgagccgcgcaagcggcccagcgacgatgagcgccgccgccaaccaggctactgctattcggacagccgcttcatttatggcgaccggcagctgggcctcctggaagcccgcttcctgatctacctgccgacctatctgtttctgctggacaggctggccccggagccggtgctgcgggagctgcgccggcacatcgccgccgatggtccggtgctgttctacgactgggacgccaatcaggacatcgccgacaccagttcttcgttcagccactccgccattctggccgcctggttcaacggcacgctggagcggcgctaccgcgagctggccggccgcctgctgtcgcccgccgacaaaccggccttcgacgccgcgctggacggcctgctcggccgctatcgcgccatccatcgggagaaaccatgacgctcaatccggctctggcccgccggctgtactggggctgcgaaaaactgcaaggccgccaggatgtggcgcaacgcctgcgttggctggaagaaacccagcacctgtcgccgcaggcttgccgcgaactgcaaatgcgcaagctgcacgcgctgctcagccatgcctacgaaagcgtgccctattacacccgggtgttccgcgagcgcggcctggtgcccgacgacttcaactcgctggccgacctggccaaactgccgctgctgacccgccaggagctgaccgccaaccaggcggagctgatctccagccgcgccgatcgcgccacgctgcaaaccaattacagcagcggctccaccggcaagcgcgcctgcttcgtccaggacgccgacttcaggctgtggatgcgcgcccaccaattgcgcacctaccaatggtgcgccggctggaaagtgggcgaaccgttcgcgctgctatggggctcttccatctactggagcttgaaaagcgtgtcggaccagctgaagaatctgctcagcaaccggcgcgaattcaacaccttccggctgtctcccgaattgatcggccagttcacccgcagcctggccagcttcaacccggtgctgatcagcacctacaccaacgccatgcacctgatcgcccggcaaatggagcgcgaagcggtcaaggtgccggcgctgcgcgccatccagggcacctcggagccgctgccgcccatcatccgcgagcggctgcaaaaggtgttcggctgcgaggtgtacgacaagtacggctcgcgcgaaaccaatatcgtcgcgcatgaaagcccctgccacgacggcatgctgatccaggtggaaaacgtcgcggaagaattcctgcgcgacgacggcgccgcctgccagcccggcgaaaccggccgggtggtgctgaccacgctgaacaatttcgccatgccgctgatccgctacgaaaccagcgatctggccgcgccgctgtccggccactgcgcctccggcctcggcctgccgcgcatgagccatgtcgccggccgtcagcaggatctgatcgtcacgcccgacggcgcttatgtcgacgcttacctgttctctttcctgatcatgcgcttcgaggaaatagaatggttccaggtggtgcaggatagcctggacagcctgcgcatccgcttgatggcgccggccggcatctcccgccagcgctgcgacgccatcgtcgagcgcatccaccaccacaccggctacccattccgcatcgaattcgaaccattcgaccgcatgccggaatcgcccaccggcaaattccgtctgtgcgtgtcggcgctcagcgacatcggcacccgccatccggtgaacccatgaacgcagacatcgcggtggacgagatgcgcgaactggccgcgcaagcgctgcaacgctgcggcgccccgtccgcgcgggcccggcaggtgatcgacgacctgctggaaaacgaacaggtcggctatccctcgcacggcatgctgcgcctgctagactacgccgccgatatccgctccggcgcgctcgaccccgccgccctgcccgccatcgagcagaccgcggccaatatcgccatcgtcgatggcaggcgcgccttcggcatcctcgcccggcagtccatcgccgaggccttgcagcgcatgtgccgcgagcagcccttggccatggtctgcctgcggcatggccaccaccttggcaggctggcggcgctaggccgcgaactggccggcgccgcccggcaaccgctggcggtgatggggttttgcaacttccagggccgcggccagagggtggccgcgcccggcggccggctggggcggctctgcaccaatccgctgctgctggccttcccctccgccgatgccgacccggtggtgctggacatgagcaccaccgccgtgtccgaaggctatgtccggcgccgcgcccaagaaggcgccgcgctgccttccggctgcctggtcggcgcggacggagagccggcgctcgatcccgccctgctctacgcccagccgccgcaagcgacgatgcagccgctgggcggagccctggccggccacaaaggctacgggctggcggtattcatcgaattgctcgccggagcgctggccggcgccggccatgtcgcccgaccggaggacgcaggcaacggcggcttgttcctggcgatcaacccggcgctcgcgccatccggcctagccgccgtcaaagccgaggcggccgccatcgcccggcattgccgcgagaccggacaggctggccgtttggccaggatgcccggcgaaggctacgccgaacgccgccgggccgccgccgcacgggccatactgacacttcccgccgccacgctagacgccatccggcatctggccggccagcaccaggagaacccgcatgtcgaatgacgcgcccttccatccgctattgaatgccggcaatccgatcaaggacaaactggctgccggccgcacctgtttcggactgttcctggtatcggccagcgcgctgatcgccgaatgctgcgccacccgcgggccggactggctgctggtggacatggaagcgtccccggccgaccgccgcgacttgatccagatgctgcaggcgctgaacggatcgcacaccgccggcatggtgagggtggcccgcaacgagcgccacttgatcgaggcggcgctggacagcggcgcgcagggcctgatggtgcccaaagtagactcggcggccgatgcccgggcagtggcgaattgcgcctattacccgccgcgcggccgccgcggcgtcaaccccatccgctgctccgcttatttttcacgcctgcccgactacttcgccgaagccaaccagtccttgctgaccatcgtccagatcgagtcggcgcaagcggtggccgaagccgacgacatcgccgccgtcgacggcatagacgtgctgttcatcggctgcggcgacctggcctgcgacctgggccaggccggccaggtgaccggcgcgctgatggacgccgcgatcgaacaagtgctcgaggcctgccaccgccacggcaagatcgccggcatcttcgcctacagcctggaattggcgcaacgctacgcccgccagggcttccgcttcatcgccttcggcaacgacatgaaactgctggcgcaatcgctggagcaacagatgcgcagcctggaggaattcgcttcaccatgatgcggctcccgccatcgcatcatggcgcttgcagactggcggtttggcaagcctctttcatacgtcaagactttgggagatcgagatggtcgcacacaatgaaaccagcgccggcgtcgaaccgcgccccgcctccggccgcgagcaggaagcgctggcgctgatgcgcagctacatgccctgggcggccggcgccggcctggtgccggtgccgctgctggacatggcagtgatcgctggcgtgcagctgaaattcctggccaggctgtcggcgctgtacgacgtgccgttcagcgaaaaccaggccaagtccatcatcgccgcgctgctgggcagcgtggtgccggccagcatcgccaccacggtgttctcgctgctcaaaggcattccgctcctgggcttcgccgccagcttcctgacgctgccggcgttgggcgccgcctccacttatgcgctgggcaaggtattcatccagcacttcgagtccggcggcaccttcctcaacctcgatccgcagaaagtgcgcagctattaccaggaacagtttgaacaagcacaaaaataacgccccgtcccggccgccggccttgcgccgcggccgggacgcttgccggaagccctgcccgatgaagccctgccctccccgccggccgcgccgcggcctgctgacactcgccttttgcgccgccgcggcttcgcacccggccgcgcgcgccgacttcccttacgccaaggaccagacatccccggtgcagaccgccacgcagaacctgccgacacaacgcggctccatcgacatcgccatcagccaggcgcatgtctacggcctggacacgcccggctcgcatagctattgctcgccatcgatcaaaatcatcaatcacgcgtcggacacgctgcgcacgctgatcctcggcatcgaataccacaagaacggcagccgcgagtcctccggctcttcggtggtcaatctgacttcgccgctggagccggacaattacagcaccacctatttcaatccgctgaatgtcgccagttgcaaggacctgcaaggcgccgtcactgtgctgagctgccagtacgccttcaatggcgattgcggggccgatgtgcgcgccatcggcttcggcgccatcccgctgcagcgcgccgccggcaagaaaccatgaggccacgccatgattatttattcctacttgggactatgcctggtggtcgcctacatgggcagacacacccggctgggctttctgcgcaccatgctgttctcgatattcatgacgccggtgctgatgatgatctatctgctgatcgcctacgccaccgacgaacgccgctgaaacccaccacgccgccacccatcgcctactgaaatgctgctatccaaattccttttccaaaacagcaagctgccgatgaaacggctgggcgtgatggccgcgctggccagcgcctccaacgccagcctgttggcggtgatcaatcacgccgccgagcacatcaaggacgtggacatgcagttcttccacgtgctcatctacggcctggtgctgaccctgtacatctacagccagcgctatgtgctgctggctacctgcgacgaggtggaggacatcgtccaccagatccgctgccggatggtgaagaccttgcagtcgtgcgagctggccatgctggagcacagcggccacggccgcatctattcggccatctgcaacgatacccagaccctgtcgcaggcggcctgcaccatcgtgctgggcttccagtccatcatcctgatcgtgttcgcgtcgctgtacattgcctggctgtccctgatgtcgctgctgctgatcattgcggtgatggcgatcgccaccctgatctactgggccaagatgaaatcggtgcatgcgatgctgtaccaggccaacgaacaggaaagccggctgcacgaccagatcggcagcctgctcagcggcttcaaggaggtcaagctgtccagccgccgcgccgaggcgctgatagacgatgtcgaaaccacgtcggaaatcaccgcccagttgcgcaaggtggcgcagcgcggcatctccatcaacttcatgttcgcccagatcgcgctgttcctggtgctgggcagcatggtgttcgtgctgccggtgttttcgccggcctataccgacacggtgatgaaaacgctgaccgcggtgctgttcctggtggggccgatctccggcatcatcgccgccattccgcagatcgccactgcaacagccgcggtggaaaacctgcaggagctggagcgcgcgctggccagccatgcccaggccgcgcaaaccgcggccgacgaagcggccgccttccgcagcctggaattgaagaacatccatttccgccatgaacgcagcgatggccagggcttcgccatcggcccgatcaatctatccatccaggccggcgaaatcattttcatcaccggcggcaacggctccggcaaatccacgctgatcaagctgctcaccgcgctgtacccgccctctggcggctcgctgctgctgaacggccgcgcggtggcggcggagcgggcgcaggcctaccgcaaccacatctgcgcggttttctccgattttcacctgttcgacaagctatacgggctggaggactggaaccgggacgaggcggagcggctgctggaggagatggaaatcgccgacaaggccgaaatgggggaatacggcttcaacaccatcgacctctccaccggccaacgcaagcgcctggcgctgatcgcggcgatgctggaacacaagcccttgtgcgtgctcgacgaatgggcggccgaccaagaccctcatttccggcgcaaattctacgaaacgctggttcccagcctacgcgaacggggcctgaccctgatcgccgtcacccacgacgaccgctacttccatctggccgaccgccggctgcacatggaagatggccgcctgtacgaacttggcgaggaaagccaccatgcctgatgccgcagccagcgccgttccgcgcccgccgctccgccgtttcgaagcctggctccgagagctgaccattcccctcacggtcgccttcgccattttcatcttcctgctgccgctgatgatctacaccatccgtcccggccaactgggcgtgcaatggaaacgcttccagggcggcacccagcttgatcacatctatggcgaaggcacccacatcatcctgccatgggaccacatctacatctacgacgcccgactgcagcgcgtggaacgcgagttcgacgtgctgtcgtcggatggcctgacgatgaaggtcagcatggcctggcgcttccgcgtcaatccgtccaacctgccctacctgcaccgctacgccggcgagaactacgccgaaaccttgatcgcgcccagcgtcggcgcccgcacccgcgatgtgatcgcctattaccggccggaacaggtctacacccagtcgcggctcaccatccagcaacaaatactgtcctcggtgcgttacgacctgatcaacaacttcaaccccgacggccgcaagggcttgaaatgggtggaaatcgaggacgtgctgatcaagggcgtcacgctgccgcggggcgtgcaggacgccatcatcaagaaaaacgccgcctaccaggaaatgcagacctacaacttcctgctgagcaaggaggaaaaagaggccgaacgcaaacggatagaagccaccggcatccgccatttccaggaaatcgtcagcaacggcatgagcgacagctatctgcgctggcgcggcatcgaagccaccgtccagctggccaagtccgacaatgccaaggtggtggtgataggcgccggcgccaacggcctgccgctgatcatgaacatggatgacaagaaggcggaggcgagcaagccgaaggcgcggccgcgcaaaccatgagcgtcatccgctccagcagcgcctgggcgcgctcccggcccacgctggcgtcgttgtaaatcagatccagcgcccagcgctcgccgaactgcgtcgccatcagctcggtatcggccccggcccagttaagcgcggcgcccaggtcgggccgccattgcgccgccatgcctggatacgcgtaatccagctggaagtgcggccgcgggttgaactgatggcgcgccggccaatggcacaggcccagcgcgccatggctggcgaacaagtcagggcgcaaactgcgcagcaggtgcagcaccggcagcgagcgcgcctcgcagtcgcgcaccgcctgcctggccgcgtcgctggccgcggtcaggccatcccccggacgcagcggcagcggaatcggcaaggcgttggagaacaagcccagggtattgcgctgagccagcgcgcggttgcccatgctgagattgaccaccagcggctggctgagcgccatctcgcgcagcgccagcgcataagccgccagcaacatgctcctcaccgcctccgccctcatccccgcgcccaccccgggcggcagctcgcgatgcacccatcccgccggccgcgccagccctggcggcggctcgaccgcgtccatcacggcggacaacgcgtcgcgccaccatgccagtctctgcgcgccgactgcgccgccaagcaaacgctcttcctcctccagcgcctcccgcaccggccgccccgcgggaacggcaggcgccgggcagcccgccagccgcgcgccgtactccctgagcagctgctgcaggaataaatgcaccgaccaaccgtccagcagcgcgtggtggaaagtcaggatcatggcgctattcccgccctccgtgtccaccagcgtgaagcggcacagcggcggcgtcgccaggtcgaacggctcggcattgtcgcgcgccgccaaccggcgcaagcccgcctcccaatccgccgccgccaagctttcatgccggcaggccggctcgcccggctcgcccagccgcgccgccgcctcttcgccgtcgcggacgaagcccaggcggaatacatcgtgcctggccaaaacctgccgcagcgccgcgcgccataatccaggcgccgccggcccctgcatcagcgcggtgatggtgatgtgcaggtgtatcccctgccaggacgaacggatgaaaaactcctgattggatttgacccgcatgtttcctcgcaagaaacaggccgccaccgcggcctggagatgaaaatcaatgggcgcgccgagagtctccggcgcttacgctgaaggatacttgccgcgcatccagcggttggtgattgggcgcggccagctccaggtggatctgatgcggccccggcggcaagcccaccagcaccagcggatcgggcgtggcatgcacccaatgccaggccgccccgtccagatacacgtgcaggtggccgactccccgcagcgctgcgggaaccggctccccggcaggcgcgtagcgcggcgccagccggatctgttcggcgtggaagcggacaatcagcgcattgcccaccgcctggccatcgacgggagactcgatcaccagtttcggcgccggcgcatccgcggcctgagccggcgcgcagcaggccaaagccagcaaggccaaccatcccgatagtctattggtcatccccattcctcatcgcttgggcttccgccgccgtcatcgtgagcgcgcagcctggcggcccgccggaacgccattgtcattatggttggccacacccatagcgcaagcgcttcacgcgcgcgcaaaaaaaaacggaagccgcagcttccgtttgccttgcctgcgcgcaagcgcgccccgatcagcccacccagcggcgcgccgaggcgaacatgcggaaccaggcgccgttttcgccccaatccgccggatgccagctgttctgcacggtgcggaacacccgctccgggtgcggcatcatgatggtgaagcggccatccggcgtggtgacgccggtgatgcccgccggcgagccgttggggttgagcggatacgtttcggtggcgcgaccgtcgaagtcgatgtagcgcagcgcggtcagcgcctgctcctggctgcccggcgcgaacaccgcgcggccttcgccgtggctcaccaccaccggcagacggctgcccaccatgtctgcgaggaagatcgacggcgaagcggtgacttccaccatcgcgaagcgcgcctcgaactgctccgacgcgttgcggcggaacttcggccaatactcggcgcccgggatgatggacgacaggttggacatcatctggcagccgttgcacacgcccagcgcaaaggtatcctcgcggccgaagaaggcctcgaactgttcgcgggcgcgcggattgaacaggatgctcttcgcccagccttcgccggcgcccagcacgtcgccgtagctgaagccgccgcaggcggccaggcccttgaagtcggccagcgagacgcggccggcgatgatgtcgctcatgtgcacgtccaccgcctcgaagccggcgcggtcgaacgccgccgccatctccagctggccgttgacgccctgctcgcgcaggacggccatgcgcggccgcgcgccggcggcgatgaacggcgccgacggatcgccatgcacgtcgaagctcagctgggcgaacaagccgcgcggcttggcgtggctgcgcagcagctgctcgctgtcggcgcaggccggattgtcgcgcaggcgctgcatgcgggcgctggtttccgaccaggcgcagaacagctcgctgcggctttcgctgaacaggtccttgcccttgtgcttgatcaccagccggtcgtagccgttgacgcggcccagcacgaacagctcgcggccgatgccggccttcatgaagcgcgagatcacttccggggtgtcgcccttgcgcacctgcagcaccgcgcccagttcctcgttgaacagcacgcgcatgatgcggccgtgggtggcggcctccagcgatggctgcacgtagtcgtcgatgatgcgctgggtattctggcgctcgatcaccagctcctgcagatcgacgctgatgccgacatggctggcgaacatcatttccgccagcgtggcgaacaggccgccgtcggagcggtcgtggtaagccaggagcttgtcgtcgcgcagcagcgactgcacggtgttgaagaaggcggccagctgttgcggactttccacatcgggcgagcggcccttcatgtccttccacacctggccgtagatcgagccgcccaggcggcagcggccgtagcccaggtcgatcaggatcaggtcgctgtccttgacgtcctgcagcaccggggtgacggtcttgcgcacatcctcgaccggcgagaaagcggaaatcaccaccgacatcggcgcggtgacggccttctgctcgccgccatcctgccaaaccgtcttcatcgacagcgagtccttgcccaccggaatgctgacgcccaggctctggctcagctcggacaccgcctccaccgtgcggtataggcgcacgtcctcgccggggtggcccgccggcgccatccagttggcggacagcttgacgttgcccaggtggccgacgaaggcggcggcgatattggtcagcgcctcgcctatcgccatgcggccggaggccggcgcgctgaacagcgcggccggggtgcgctcgcccatcgccatcgcttcgccgcgataggtgttgaagcccatggtggtgacggccacgtcggccaccggcacctgccagcggcccaccatctggtcgcgcgccgtcatgccgccgacgctgcggtcgccgatggtgatcaggaaggacttgtcggccacggtggggtggcgcagcacgcggtaggcggtttcgcgcagcgggtatttggacgcgtcgaacacctggtagtcaggctccaccgtcttcacatcgcgggtcatgcgcggcggcttgcccagcagcacttccagcggcatgtccaccgggttgttgtcgaaatggtcgtcgcgcacctgcagatggccgtcgtcggtggccgtgcccagcaccgcgaacgggcagcgctcgcgctcgcacagcgcgctgaagcgctccaggtcctgcggcagcaccgccatcacgtagcgctcctgcgcctcgttggaccagatctgcatcggcgtcatgcccttttcttccaggtgcaccttgcgcagatggaagaccgcgccgcggccggcgtcgttgaccagctccgggaaggcgttggacagcccgccggcgccgacgtcatggatggagacgatggggttggcttcgcccagctgccagcagcggtcgatgacttcctggcagcggcgctcgatttccgggttgccgcgctgcaccgagtcgaagtccaggttttcgctgttggccccggtgtccatcgacgaggcggcgccgccccccaggccgatcagcaggccggggccgcccagttggatcagcagcgcgccttccgggatttcgttcttgtggatctgctgctgctggatgttgcccaggccgcccgccagcatgatgggcttgtggtagccgcgcatctcgccgtgcacttcctcttcgaaggtgcggaagtagccggtgaggttgggacggccgaactcgttgttgaacgccgcgccgcctatcggaccttccagcatgatctgcagcgccgaggcgatgcggcccggcttgccgtactcggcctggccgtcgcggtattgctcccacggctgcttgaagcccgggatgttcaggttggacaccgagaagccggtgaggccggccttgggacgcgaaccgcgaccggtggcgccttcgtcgcggatctcgccgccgttgccggtggaggcgccggcgaaaggcgaaatggcggtcgggtggttatgcgtctccaccttcatcaggatgtcggtgggctcgctgttgtatccgtagcggtggctgccgggctgcgggtagaagcgctcgatgaaagcgccctctatcaccgaggcattgtccttgtaggccaccagcgtgccttgcggatgggcgtcgtgggtatcgcggatcatgcggaacagcgacttgccctgctcgacgccgtcgatgacgaattgcgcgttgaagatcttgtggcggcagtgctcggagttggcctgcgcgaacatcatcagttcgacgtcgctgggattgcgtcccagcttgacgaagttttccaccaagtagtcgacttcgtcttcggacaacgcgaggcccagcttggcgttggcggccgccagcgcctcgcggccgccggccagcacgtcgacgcggtccatcggctgcgggtcgatatggacgaacagtttctccacctcgtcgaacgaggccagcaccgtttcggtcatcctatcgtgcaagaggcccgccagaatgtggcgagcctctttacttaaagatttatcggcggacttgattcggaaagccgtgccgcgttcgatcctgcggattcttggcaatccgcagtgccgggcgatgtcggtggccttggacgcccacggcgacaaggtgccgatgcgcggcgtcaccaggaacagttcgccttccggctcggcgctgagcggcggctcgccgtagctgagcaattggcccagcacgcccacctcttccagcgtcagctcgctgtcgctttccgcaaaatgccaatactcggccatcaggaccagatccttcaaaccggcatcggcagctgccgcctgcagtttttcgagacgaaacggtgacagggcaacgccaccgcgcagcttggtaatgtaagacattagacacccgcgacaagtaccaggaaagggcgtcataatacagcaaaacatcgctgcatttaaggcggtgccggagtttccgggcgcatattggcaatttttgcgatttaccccctcgtcatccgttctatcaggagcattccgcaatgaaaaaggtcgaagccgtcatcaagccgttcaagctggacgaggtgcgcgaggcgttgtccgagatcggcatcaacggcctcaccgtttccgaagtcaaaggcttcggccgccagaaaggccacaccgagctgtaccgcggcgccgaatacgtggtggatttcctgcccaaggtaaagatagaagtcatcctgccggacgatctggtggagcgcgcgatcgaaaccatcgtcgccaccgcccgcaccggcaagataggcgacggcaagatcttcgtcaccgcggtggagcaagtggtgcgcatccgcaccggcgaaaccaacgaacaggcgatctgagcgccggccacggccaaagaaaaagccgccccggcgcgggagcggcttttttcgcgcgcggcgatcagcccgcgcttacttccacagcttccaccacggcatttcctcgaccgtccacggcttggccaggtactggctcttcggatagttgagcgccagcacgcggcgggcgtcgtcgcgcagctgcggcagctgcagcttgtcgtaggcggccaccatgatggccagcgcctcttccggatacttggtgttggcgtaatccttcaccacgccctgcgcgcggttggcggcggccaggtaggcgccgcgcttcatgtagtagcgcgccacgtgcatctcgttgccgcccagcgcgtccaccagcttgatcatcttggcgctggcgtcggcggtataggtgctattgggaaagcgggtggtcaattcgcggaacgcggcgaaagcttcgcgcgccgcgcgcgggtcgcgctcgctcatgtcctggccggcccatttggcgagcaggccggaatcgtcattgaaatacaccaaacccttcagataatagatgtaatccagattggggtgggtcgggtgcagcttgatgaaacggtcggccgcggcgatggcctgttccggctctccatccttgtaatgggtgtaggccaggtccatttgcgcctgctgcgcatagcgtccgtaagggaagcgcgactcaagcgtttcgtagagcttgacagcgcgggtataattgccgctgttcaactcgtcgtgagcttccgaatacagcttctccacggtccagccgcgcgtttcgtcgtaggtttccgtggttgcacatccggcaagccccatcaccaacattgctgcaacaacgtatcttttcatgactgatccttacattgacccggacgattatagcgacatctcggaaaacgagatatccgccacgcaacatctcgaaattccgctgtcgctgggcggcgaaagactggacgccgcgctggccaaactgctgcccgatttctcgcgcagccggctgacccagtggatcaaggacggccaagtcaaggtggacggccaggtggtagcgcccaagaccaagatgctgggcggcgagaaactggaagtttcgctgcagcccacgcatgaggaaatggccttccagccggaagccatggacctgcccatcgtcttcgaggacgaccacatcctggtgatcaacaagcccgccggcctggtggtgcatccggcgtccggcaactggagcggcaccctgctcaacggcctgctgcatcactgcccgtcgctggccggcgtgccgcgcgccggcatcgtgcaccgcctcgacaaggacacctccggcctgatggtggtggccaagaccgtgccggcccagaccgatctggtgcgccagatgcaggcgcgcagcgtcaagcgcgtctatcgcgccatcgccgacggcgtggtgccgttcgacggcaccatagacgccaacatcggccgcgatccgcacaaccggctgaagatggcggtgctgaaattcggcggcaagcccgccatcacccatctgcgggtgctggagcgcttcgccagccactcctacgtggaatgcaagctggaaaccggccgcactcaccagatccgcgtccacatgcgcgaagccggccacccgctgtccggcgacccggtgtacggcaacctgcgccacaagatggatgaagacaccgccgccgcggtgaaggcgctgggccgccaggcgctgcacgcctacgcgctggccctggtccacccggcctccggcgagctgcgcagctggaaagcgccgctgccggacgacttccgccgcctgctcgacctgctgcgcggcgacggcgcgctgccggacgaagaggctttcgcccacgccgacgagcaggacgacgaagactgggatgacgacgacgatgacgacggcgacatcgaggtgatctatgcccgctgaaacctggcttgccgccgactggccggctccggccagggtccgcaccctggccaccacccgccagggcggcgtcagccagccgccgtacgccagcctcaacctgggcgcgcatgtcggcgacgcgccggacgcggtggccgccaaccgtgcgcggctgcgtgacgaattgccggccgaaccggcctggctgaaccaggtgcacggcgtcgcggtggctgacgccgccgccctccgcggcgccgccccggacgccgacgccagcttcgcccgcgcgccgggcgtcgtctgcgcggtgatgactgccgactgcctgccagtgttgctgtgcgacgacgccggccgcgcggtggcggcggcccatgccggctggcgcgggctgtgcgacggcgtgatcgaggccactgtcgccgcgatggctctgccgcctgccggactgatggcctggctggggcccgccatcggcccggacgccttcgaagtgggcgcggaagtgcgccaggccttcctcgcccgcgatccggcggcggcctcggccttcatcgacatcggcgaaggcaaatacctggccgacatctacgcgctggcgcgccagcgtctgcaagccgcgggcgtcgagcgggtgtacggcggcgatttctgcaccgtgatcgaccgcgagcgtttcttctcctaccgccgcgaccgcgtcaccggccgcatggcctcgctgatctggctgcaggactgagccctttcgcccccgccgcccggcggggcgtcccaacccgccacaactccccttccgcaaacgccgcgcggcgcgattgacccgcgcgcgccacgcgaacatcatgttgttttcaccacagccccttgccgccatggacatcgccatcgtcacgctggacagtttcaatgagctcgactcgctgatcgctgcgggcatccttggccgcatgtccccgcatggttggaacgtgcgcatctgctcgcccattcccgtcgtgcagtcccgcagcggcacgcgcctggaacgccaggcggacctgtcctatgccggcagcgccgacgcggtgctgataggcagcggctggcgcacccgcgactgggcggcggacgatgccatcatgagccagctgcggctggatcccgcccgccagctgataggatcgcaatgctcgggcgcgctggtgctgcatcggctgggcctgctggccgacggcgtcgcctgcaccgatggcctgacccggccgatgctggagcagttgggcatcaccgtcgcgccccgcgccttccgcgccgtcggcaacatcgccaccgcaggcggctgcatggcttcgcagtatctggccggctgggttctgctgcgtctggccggcgaggcgcgcgcgcgcgaggttttgtcctatgtcgccccggtcggcgaggaagccggcttcgtcgacagggccatgtccgccatcgccgcggcgtccgagcccgttcccgaatgaaaaccatcccgctcgccaggctgtcccccgccgacctccatccctgcttcctggaggcgttcagcgactacctggtgccggcgcaacccagcctggaatcgttcagcgccatgctgcgccggcgcggctgggtgcccgagctgagcgccggcgcctggatagacggccggctggccggcttctggctatgcgcgacgccgccgattgacgacggaatggaaggttattgcatcgctgccggcgtggtgcccgccgcccgccgccagggggcgctttccgcgatggcggcccgggtggcgcgcctgctggccaggcgcggcatccaccagcaaaggctggaagtgatagacggcaatcagcacgcgcagctggcctacgcccagctgggcttccagccgctgcgccagcttgactgctacctgctgcaggtgcccatcgacagccggcgccattggcccgtcacggtccatcatggctacacgccggcgcgctggccaagcgctgactggctggcctatccgccggcggtgccgaaccgccgggactcgctgcggcgcgccacgcccgccccgcgctggttgacggtagacgccggcggcgcggcgctgggctcgctgctgctgtcggccgacggcgaagcgctggagctgatggtggacccggcccaccgccgccgcggcatcgccagccaactgctgcgcgcgggacagctgctgacgccgggcggccggctggcattcaacaacgtcgaccgccgcgacctggccctgctcagcctgctgcttcggcaccaggccgcctaccggctgtcgcaatgggaaatgctgaaaccggccgcagccgaggccggcattcgctccgcgcggtgataaaatagaaagtgtcggcggcggcgcgtccgcagccggcgccattcacgcgacacaaccagccaggccgtccgcttactcgcggcccggcgcagaatccaaggccagcccgatgactccacaacaacaaaccgactggcagaaccgcctgatcacgctgctcgagcagcaaccgcccgacgacgacggcgcccacgacctcagccacctgcaccgggtatgggcggtggcgcgccagttgctggcccaccatcccgaagccgatgcgcgggtggtgatggccggctgttacctgcacgacctggtcaatctgccgaaaaaccacccgcagcgccagctggcatcgcactggtccgccgagcgcgcccgccagctgctggccgacgacgcgctgtcggccgagcagctggacaacctggcgcacgccatcgaggcccatagctactccgccgccatcccgccgcgcacgctggaagccaagatcgtgcaggacgccgaccgcatggacgcgctgggcccggtcggcctggcgcggatgttctacgtttccggccgcatgggccgcgcgctggcccacccgctggacccgctggccgaacagcgcggcaccgacgaccaggcctgggcgctggaccatatcgcggtgaagctggccaaattgccggcgatgatgcagaccgaagccggccgcggcatcgccgagcgcaagctgcaatggctgctcgccttccgcgacgagttctgccaggactggatggcccgctaggccgaaggcgcccccgccatgatgatccgcaagctgccgcgcaacaccgcaggccgcgactgggtggtgggggatctgcatggctgcttcagccaactgggccggctgttgaaaatcatcgccttcaatccggcctgcgaccgcctgctgtcggtcggcgacatggtggaccgggggccggaaagccggatggcggtggagtggctgacgcagccgtggtttcacgcggtgcgcggcaatcacgaacagatggcgctggacgcgatgcgcaatccgctggaagacctggagcgccacctgcgcaacggcggccgctggctgaccgagctgagccattccgagcgcgacgcctgcctcgccgcattcgccggcctgccgctggcgctggaaatcgacgtggaaggcggcaaaatgggcgtggtacacgccgactgccccgacaacgactggccgtcgctgcgcgccaggctggaagccgacaatccccgcgaccaggactacgaggcgctgctgtggtcgcgcgagcgggtacgaaacgggggcggcggcgccgtccatggtctggacctgctgctggtggggcacacgccgcaggaaaacgccatcctgtacgacaacgtgatgcacctggacaccggcgcggtctacggcggcaagctgacgctgttctgcgtcagcgacttcgtcgaagtctcgttgccggccagcttcgaacacatggcgcagttccagctgcattagacgcccgccgccgcctgcggctagaatgcgcggccagcataccaggaggccatatggccgagcacaagaagaaatccgccgcccccaaggcgggccaactggaccgccgcgttcaggagcaacgccacggccaggccgaagacgcctgccgccgcctcgtcgcgctgctggaagccctggccgccgacggccgcctggacggcaaccagcaggccagccaatacctgaactccacccgcgcctactaccgccgcatccgcaacggcaaggtgatgggagcggccgacttcaccgccgccgccgacgtctgcgcctgcgcccgccgcgcgctggccgcgctagacccagaactcgtcttcgccggactgccgcaggcggacgagctgctgcaggccctgcggctgggcgaacaggtggaaaccgaaatgcgccggatcaaagccgccggcaaagctggctgaggcagccatccgcatggcatgatggctgcaccgccacgccataggtcgccatcatgtacaaccgcattccccatctgcgcgtcgcccgcccggtcagcaatctcgccgccagcaaggccatgtattgcgaaggcctgggtctgcagctattgggcagcttcgccggccacgacggcttcgacggcgtgctgctggggctgcccgacgccggctatcatctggaattcatcgtcagccatcggcatccggtcagccccgcccccggcgtggaagatttgctggtgctctacctgccggacaaggccgaatgggaggcgctgtgcgcctgcatgcgcgccgccggcttccgagccgtgccgtccgccaacccgtactgggacgcgcgcggcgtcaccttcgccgaccacgacggctaccgcaccgtgctgcaaaacgccaaaagcccggtataagccgctatttgacttcgctggagacgattttctccagcagcccggacgcgcgcatctgctcgatcacgcggttgaactccggcgcccagtgatcggcgccggccgcccgggaaaagccgaaggcggcgtagctcaactcgccgatcggcacgtcggacacgccgatcgcatccgccacgccctgttggttgaccagatatttgccgacattcgaatcgatggtcgccaggtcgatgcggccggactcgatcatcttgatcagggtgaccgaatcccgggcccgctctatcgggtgcgccgtcatgaaggcggcctccatgtccttgtcgaccaccgagcctatctccatgcccagccggtgcgttttcagcctgtcgtaatcccgccagtccaccgcgccgcggaatgcgctcttcttgtacaggaagcagttgtactgccgcatcaccggcgcggaaaactccatgtactgctcgcgctccggcgttttgtacagcggcaggatgccgtccacccgaccctccttggcctcggtcaggcagcgcttccagggcatgatcttcaccgtcaccgccaggcccagctgccggcctatctcctgcagcaggcgcaccttgatgccgccgccggccacagtgtcgaactcgcccagcgcgtacggcgggtacttgtcgtagcacatcgtcagctcatccgcccgggcgccaagcgcgcacagcatcgcgggcagcagaaacagcagcctggctaacatgcggcttccccggtcgagtaaacgatcatgcgcggcgctccgccggctagccttccaccgcctcgctctcctgctgcagctgccacatttccgcgtagcggccgcccagggccagcagttcgcggtggctgccctgctccaccacccggccggcgtccagcaccaggatgcggtcggcgtcgaccacagtggacagccggtgggcgatgatcagcgtggtgcggttggccgcgatttccgccaactcgtgctggatggctttctcggtgcgggaatccagcgcgctggtggcttcgtcgaaaatcaggatcggcgggtttttcagaatggtgcgggcgatggcgacgcgctgcttctcgccgccggacagcttcaggccgcgctcgcccaccagggtgtcgtagccgtcgggcaggctggcgacgaaatcgtggatatgcgcggagcgcgccgcctcaatcacctcctcgcggctggcgccggccttgccgtaggcgatgttgtagtagatggtgtcgttgaacagcaccgtgtcctgcggcacgatgccgatgtgggcgcgcagcgagtcctggctcagctcgcggatgtccgcgccgttgatgcgcaccgcgccggcgttgacgtcgtaaaagcggaacaggatgcgcgacagcgtcgatttgccggcgccgctggctcccaccaccgccagcgtctggccggccgggatggcgaagtccacatcgtgcaggatctggcgcttgctctcgtaggcgaagcccacccgttcgaagcggatggcggcgctgcgggtatccagcgttttcgctcccggcgcgtcggccacttccagattgacgtccagcagcttgaacatccgctcgatgtcggccagcgaatgcttgatctcgcggtagacgaagcccaggaagttcagcggcgcgtacagctgcgtgatgaacgtcgccaccagcaccacgtcgcccaccgtcatccggtgcgccaccacgtcgcgcgcggccagcaccatcaccagcgtgacgccgatggcgatgatggccgcctggccggcgttcagcaacgacagcgacacctggttcttgatcgccgacgcttcccaggcttccagattgcggtcgtagcgcttggactcatactcctcgttgttgaagtacttgaccgtttcgtaattgagcagcgcgtctatcgccttggaattggccttggaatccagatcgttcatggtgcggcggtagacggtgcgccactcggtcaccagcaatgtgaaggcgatgtagagcccgatggtgcccagcgtcaccgccgcgaattcccaggcgtagcggtggaacaagatcgccgtcaccatgccgatctccagcagcgtcggcaggatgttgaacacggtgaaattgagcaggaagcctatgcccttggtgccgcgctcgatgtcgcggctcatgccgccggtgtggcgctccagatggaagcgcagcgacagcctgaacagatggcggaacacattgcgcgccacgctgcgcaccgcgccctggatcacccgggcgaaaaccgcgtcgcgcaactcccccagcacgccggacagcagccgcgccacgccgtagccggtcagcgccagcaccggaaccgccagcagcgtggccggcagcgacagctggtcgacaatgtccttcaggtagagcggcaccgtcaccgccgccaccttggccagcaccatgcagccaagcgccagcatcacccggcccttgaaactccacagatacggcaacagcgtcttgatggtttgcaaatcgtttcgattggccggggccgggccgctatgactgatgcgcataaagggtttgcctgtcgatctatcctgtccgaaagtgaagaaggctcactcaacaaggggcaggcatcatgtggattctgttgctggaagctttgggcgccggagcgctcgcctccttcatcgtctggtggacctggccgcgcgaggacaaggacccgtcctgtaaacgcgactagtgcagcacccgcggcgctaccagcgtcatttccgggatttccgcctcgaagcgctggccgtcgtcggccaccagctgataactgcccttcatgctgccgtacggcgttttcagatgggtggcgctggagtactcgaaagcctggcccgggtccaggtgcggctgctcgcccaccacgcccatgccgcgcacctcctgcacctgctggttggcgtcggtgatgatccagtggcggctgaccagctgcgccggctcgctgccggtgttgacgatgcggatgcggtagccgaacacgtagatgtcgttggccacattagattgctcgtcgatgtaatgcggctccgccatcacttccatgaggtaggtcttgtcggccattgcggcttctcctgattgatatggttttcattttatcccgccaatggccttttggcgcggtagaatgcccggcatccgtgtttatcgatgtcagagcaatcgccatgcgcactttccgtatcgcccccagcattctgtccgccgatttcgcccgcctgggccaggaagtcagcgatgtcgtcgccgccggcgccgacatcatccacttcgacgtgatggacaaccattacgtgccgaacctgaccatgggtccgatgttctgcgaggccatccgcccgcacacccaggcgccgatcgacgtgcacctgatggtgaagccggtggacgcgctggcggccgccttcgccaaggccggcgccgacatcatcaccttccacccggaaggctccgagcacgtcgaccgcacgctgggcctgatcaaggaagccggctgcaaggccggcctggtgctcaacccggccacgccgctgtcctgtctggaccacgtgatggacaagctggacatgatcctgatcatgtcggtgaaccctggctttggcggccagtccttcattccgcacgcgctggagaaaatccgtctggcgcgccagcgcatcgacgaatacaccgccaagcgcggcggcgagatctggctggaagtggacggcggcgtcaaggtggacaatatcgcccaggtggccgccgccggcgccgacaccttcgtggccggctccgccatttacggccagaaggactacaaggcggtcatagacgccatgcgcgccgaactggcccgcgtgcaaggataagcgcgcagccgtttcattcctatccatcaaagggataaagcaagcaatgcatgcattcatcgtcaccggcgcctcgcgcggcctgggctacgccatctgcgaaacgctgctgaacgacggctacttcgtcgtcggcgtcgcccgccatgccggtccggcgctggaaggcctggccgcccgccacccggagcggctgctggccgtcaacgccgacttggccgacgccgcccaggcgtcggcgtcgattcactccgcgctgcagcaactgccgctgtctgagtgcgcgaccgtcacgctgatcaacaacgccggcgtggtgacgcccatcgcccaggccggccgctatccggccgacgaggtggtcaaggccgtcgccatcaacgtcaccgctccgctcctggctagcgacgcgctgctgtccgccaccgaccatctgccggcgcgccgccgcattctgaacatctcgtccggcgccgccgccaaggcctaccccggctggagcgtgtattgcgccaccaaggccgcgctcgaccacttcagccgcagcgtcgccgtggagcaggaaggcaaggccaatccggcgcagatcgtcgcgctgtatccgggcgtggtggacaccgacatgcaaggcgatatccgcgccagcgacgaaggccagttcccgcaaaaagcgcgcttcgacgcctacaaggccgacggcgcgctgagcagccccggcgacgccgcgcgcaagatcgtcgactacctggtgtcgccggccttcggccaggcgccagtcgtcgacatccgcgagctgtaagcccgcattcttcaattccgccgcggcccgccggccgcggcttcaaaagccaatatatgaatctcaagcacatcaaagccgtcgccttcgatctggacggcaccctgatcgactccatccccgatctggccaatgccgccaacgccatgcgcgctcatctgggcctgccgccgctggacccggagcgcatcaagagccatgtcggcgacggcatcgccagcctggtccaccgcgccatcaccgacgagcgccacgccgaggccgacggcccgctgtgggagcgcggctaccgcttcttcatccagcattaccgcgaacacctggccgaccagaccacggtctacgccggcgtgcgcgacggcctaagcctgttgcgcgccctcaagctgccgctgctggtcatcactaacaaatccgagcggctggccgtgccgctgctggaacaactggagctgcgcgaccacttcagcctggtcctgggcggcgacaccctgccggagaagaagccatccgctttgccgctgcaacacgcctgccaggtgctgggcatctcagccaaggaaatggcgatggtgggcgactccgccaacgacgtggccgccgcgcgcgccgccggctgcgccgccatcgcggtgggctacggctacggcgacgccgcctcgctgggcgccgacctgaccgtggccagcattgccgagctgtacgatttgatgaagaatgacggctccatctcactctaaaaccggaaacccctgactcatggcttttcttcccgctcccgccagctggcgatggcgccgctgcacccgctcccggcgccccgcccccaactgacagaacccaaggaagaacacccatgcagccacagactttccagcaactcgccgccgaaggctacaaccgcatcccggtcacccaggagctgctggccgatctagacagcccgctgtccatctacctgaagctggccaaccagccgtacagctacctgctggaatcggtggtgggcggcgagcgccgcggccgctactccatcatcggcctgccggccgacacccgcctgcgcgtcaacggccagcgggtgcaggtggagtgcggcgacaaggtgatagagcgccacgacggcgatccgctggccttcatcgaagcgttccagcgccgtttccgcatccccgagctgcccggcctgccgcgctactccggcggcctcgtcggctacttcggctacgacaccatacgctatatcgaacgccgcctggccgacgtccagaaaccggacccggtgggcacgccggacatcctgctgatgctgtccgaggaaatcgccgtggtggacaacctgtccggcaagctgcacctggtggtgtacgccgacccggaagtgcccaacgcgctgcccaaggcccaggcgcggctggcgcagctgcgcgccaaactgcgcgagccgctcgccattccgctgtcgctgcccaccggccccgccgcggaggcggtgtcggaatacggcgagcaggccttcatggacgcggtggccgccagccagcgctacatccacgacggcgacatcatgcaggtggtgctggcccagcgcatgcagcagccctaccagggctcgcccatcgccttgtaccgcgcgctgcgcaacctcaatccgtcgccgtacatgttcttctaccatttcgacgacttccacgtggtgggcgcttcgccggaaatcctggtgcgccgcgagggcgaaaccgtgaccgtgcgcccgatcgccggcacccgcccgcgcggccagagccgcgaacaggacgaggcgctggccgccgagctgctggccgaccccaaggaaatcgccgagcacgtgatgctgatggacctgggccgcaacgacgtcggccgcgtcgccgacatcggcacggtcaagatcaccgacaatatggccatcgagcgctactcgcacgtgatgcacatcgtctccaacgtcgaaggccaggtagaccgcaagatcagcaatatcgacgtgatcaaggccaccttcccggccggtaccctgtccggcgcccccaaggtgcgggcgatgcagatcatcgacgagttcgaaccgaccaagcgcggcgtctacggcggcgcggtcggctacctgggcttcaacggcgacatggacctcgccatcgccatccgcaccgcggtgctgaaaaacggcatgctctacgtgcagtccggcgccggggtggtggccgactcggtgccgcaatcggaatggctggaaacgcagaacaaggcgcgcgcggtgctgcgcgccgcgcaaatggtggccgatgggctggatgcctgaatccggccctccgctccgccccgctccacgccgccggccccgcccggcggtttgcattttcggaccgccatgaaaaatggcggacgcccccgagggagcatccgccacgcgccgattctcgcagagcgctcagcgcttggtcagcgtgatccagctgtttgccggcacccgcaaagtccagatgccgttgccgatataagagaactgcttgctggtatcgtattgcccatccatgggaatgagcggcttgtcggcggacagcgcaatgcccggcagctggatttccctgccctgcggcagcagcggactgcccggcagcaccacccgcttggccggataaccatagcgccccgcgacattcgccgcgccggcgctcagcatggtgccggcgtagcgctccagcatgtccgcataaccggcgccgcctgcggcccgcaagccctcggagaccgcctgcgcgccgggattctggctttccagccacggccggaacaactgatggccgtattgatgcaccatcagcgcgcccaaagccagcgccttgggataacagctgctcgcgccattccagcgagagaagtcgcaagggacgaaatcgagcgcccgctcgaagtccgctcttggccgcaagtccggatgcgcgtcccgcccggcgccgcgcccgccgccgaaggtatcggccagcaccagataagcgatcgactgggcgaacatttcgtcctcccaggtttccaccttgactgggacagccggtttgtagcgcttgttgtagctgtaaaacaggtgggaaaactcatgcgccagcgtggaaagcgcctcgcccgcgccttgcgagcgctcatgccactcctcacccgccgcgctgcgcgccagcacttcggatgacaagaagaccgccagcgccgcgttgctgcgctggtatttctggcatggtttcgcgtcttccgtgcacaaattgcgcagcgcgttgcccgaccagacataacccatcagcccggcggcgttgccctgggcgcgcaacggcgtcaccacgatatggacgtcgcgggtatccgccgggatggtaaatccggcgaacaccggattgccgaccacgccccacggctgccccagcagcgacacctcgagcgggtagacgctgcccgcgaaacgctcggccaggaagtcggcctgcctggcgctgacgccggcgccgttctcggtccagacatgcaccgaggcgccgcccggcagcgcgcgctttgtcctgagcgtggtcgcgacatcattctcatggatggaatcgaaccatgtcttttcctcgcccggcgcatatgcgaccggcgcctcccgcctggcgccctgccccagcttcagacgttgcgccggcgctttctgcgcgtaaatcgcgctcagctcggcatgctccgcctgatagtccggctcgcgcggcccggcgtccttctcttcctgacgcaggctgagctcgccggccgccacgccggcgccgctcaccttggtcgagaccgcgtgccagatcgccggcgacaggcccgataccaccagctcacgttcaagatggctgtcattgtaaaaacggtacatcgagccgaccgcctggttggcgccatccgccaggcggcaacggttgccgctgcagaccaactctcccgcctccgcccccgacttcgcctccggcgcggcgccatgcgcaaccgcgccgccgccatcattggcggatggcgaaccacctcctccgcctcctccgccgcatgccgtcaaaccggcaaccatggccgtcagcaaaagaggtctgagcatttcattcatacaagttcacagttgcaatattaattaacaagaatgtaataatactcatggcagccatcaagaaaatacaagcctgctcgatagcggcaaatcccggaagagttgttgctctaaagcaacaaaattccaataaatattctagttgggtcataaatttaatattttcacccagaaaaacccgtaagcagtatgtaaacaaaccacgccgccctacagtcctttgccctctccgctaagcgaaagggttcattgccgcatcgccgacgcgggaagcgccctctgcccggggctctggccgcaggatgaaatttcaacgtcattttcatgcccccccgtcccctcggcgcgaaaaggcgtttatcgcagcgcgcggcgcggccgggtctcgcccgcgaaggaaaatcatcaagccgcgctgtcgccggcccgcgccgcgaactagtctgaatgcagactagttcagaccccaaggtgactgtcatgctgctgcacgatatgcggacacgccataaactggccctgctgctggcgatcccgctgctggccatcgccgccgtagccggggaagggctggtgaccatggccgaattgaaggaccacgtcgccaaggtttacgtcagcagcgccgcgccgctgttcgaagtgtccaaggtcagctctctggtgccgcgcacccgcatagacgtgatgcaggcgatgatggacgccatggccggcggcgccggctaccgcacccccacccagcgcgccgaccggctgtacggcaagataggcgaaatgcgggaggcgatcgccaagctgcagcaaggacacatttcagcggaactgaaaccccaggtggacgccatcgccgcgctgtatcaggacatggccgccaacagcctggagcccttcgtcaacgccatccgcgccaaccgcatcgaggacgccaaggcgatctatcccaaattcgtcaagcagtacgaaggactgcgcgaccaggtcggcgcgctgatgccgcgccagctggctatcgccgaaaccgcctaccaggacgccaaccgcacctatcagagccaaagccggctgatttacggcgtgctggcggtgtcggtgctgctcagcctggccataggcttcgcgctggccaagctgattagcgaggaattggacaagctgcgcgccaccatgctggaagccgccgaccacttgcggctgagcctgcgcgcccgcgtcggcggccgcgacgaattcggcgaagtggccgatgccttcaaccggctgatgtcggcgttcgaatccgcattgcagcggatacgcgcggtgggcgaacaggtgagcgaacgctcgcacgcggtggccgacgccgcgcgcgccatcgcccgcggcaccatggagcaaaaccaggcggcgcagcacaccaccaccgcggtggaggatgtctcggccagcgtgcagcgggtggcgcagaccgccagcgacagcaccgccttgtcgctgtccgtgcaaaccctgtccgaacagggcggccaggtgctgacggaaaacgcatccaacgccaacaccctgcacggcgccatccacaagaccgccgaactgacgcagagcctggcgcagcgctcgcagcagatcaacaacatcgtcagcgtgatccatgacatcgccgaacagaccaatctgttggcgctgaacgcggcgatcgaggcggcgcgcgccggcgagcaaggccgcggcttcgcggtcgtggctgacgaggtgcgcaagctggccgaacgcaccaccagcgccaccggcgagatcggcgccatgctgggcggcattcagagcgacgtggccagcgtggtcaaggacactcagatgtgttcggaattgatagaggagagccggcgcagctccgaacgggcgatggaggcgctgcagcagatacgcggcggcgccgagacctcggcgcggcagatcgccgagatcgcctccgccaccgtggaacaaggcgcggcgacagcggatatcgtgcaaaggatagagcacatcgcggcgatggccggcgagaacgacagctcggtgcaggcagcgtcggccgcggcagacagcctggcggcgctggtcagccagctggaagcggaaatcgaccgcttccgcgcgcgctgacgccctgcccgcctcagggcttgctggcggcgtggatcgccagggtgcccagcagagtgggaatctgccggaccagccgcacgccggcaaaaccggtttcgcccatcagccggggcagcacgccttcgacattgccctgggtagtggcgaaaccatccagccactgcaccggatagaacaacgcgcgcatcagccggttttgcggcacgccccaatcggcgacatataactcgccgcgcggcttcatcacccgttggatctccaccagcgtgcggcgcttgtcctcggtgtccagatggtggaaaaacaggctggacaagacccggtcgaaggcgttgtccagatagggcatggaaaacgacatgccttggcgaaaggccagcctggcgcccgcccgttccgccttgtccgtcgccaggcgcagaatgcgcccgtcgccgtccagcccctgcaccagcaggcccggcgcgcgcaggctggccgctatcgccagcgtgccggtgccgcagcccacatccagcacccggtgtccgggccgcagttgcgcggcgtccagcaacgcgtttttgaaatgcttctcccgggcggtaagcgccaccagcggatcgtaaagcgcggtcaatgccgaaaagcgcagcgcatggatatattgccgcctggatgaagccatcggtgttctcctggttgaccggccacggcccggaacccggcccggacgcgcgacagcctccttaccctagccgacccgcgcttgccgacaaaccgtctgaatggccaccctccccctgtcgtcaggccacttttcacgccgcggccgtggcgaaggcgcaacagaagcggcgctcgcggcgcgacaccgcccgcgtccctggcacctgctgccggccagcgcgtggttttccgccatttcctgtcgacgccattccgccgccgcgacggccccgaaaaaaatctcacgccgcaaagccaataacgacgcggctttccttggtttcagacaaagtcaagacttgaactacgtcacccccaccactagaatttgggcatctaaagcgctgcggacagcacatcttgtgtttacccacaaacagcgcacagcttttcaacaaaattgtccacaagccgacctgccctcaagaacgcagcgcggccgggcctaaacttctctttatcgagggatacatgcaattgaccacctttgaagggcaaaccgccgcagaactcggccgcgccgccgcgccgcaagccgatttcagcctgtacaagaccattcgccgcaatggcgcggtagtgccgttcgagcctgtcaaaatctccatcgcgatgaccaaggccttcctggccgtggttggccaacaaggcgccacctccgccagcatccgcgacaaggtggcccaactgaccgaacaggtggtcaatgcgctgatgcgccgcaagcccgaaggcggcgcgatccacatcgaagacatccaggaccaggtcgaactttcgctgatgcgcttcggcgagcacgatgtggcccgcgcctacgtgctgtaccgcgaacaacgctcgcaagaacgcgccgcgcgcggcgaggcgctcacccaggtgcagatcaacgtgctgcgcaaggatggccgcaaactgccgctggacgtggcccgcctgcgcggcaacatcgaagccgccagcaagaatctggccggcatcgacgtcgacgccatcctcggcgaaacgctgaagaacatctacgacggcgtgccggaagaggaagtgggcaagtccgccatcctggccgcccgctcgatgatcgagcaggacccggcctacgattacgtgaccgcccgcctgctgatgggcaacatccgcctggaaatcctgggcgaagccgtgggccaggacgaaatggccgcgcagtatccgcactatttcgccagcttcatcaagaagggcatcgccgccgagctgctggatgaaaagctggccgaatacgacctgaagaaactgggcgccgcgctggatgccgagcgcgacctgaaattcggctacctgggcctgcaaaccctgttcgaccgctacttcctacacatcgacggcacccgcatcgaaatgccgcaggccttctacatgcgcgtcgccatgggcctggcgctgaacgaagtgaaccgcgaagaccgcgccattgagttctacaacgtgctgtccagcttcgacttcatgtcgtccaccccgacgctgttcaactccggcacccgccgcagccagctgtccagctgctacctgaccaccatcgccgatgacctggacggcatctacgaaggcatcaaggaaaacgcgctgctgtccaaattcgccggcggcctgggcaacgactggaccccggtgcgcgcgatgggctcgcacatcaagggcaccaacggcaaatcgcaaggcgtggtgccgttcctgaaagtggtcaacgacaccgcggtggcggtgaaccagggcggcaagcgcaaaggcgcggtctgcgcctacctggaaacctggcacgccgatatcgaggaattcctcgaactgcgcaagaacaccggcgacgaccgccgccgcacccacgacatgaacaccgccaactggattccggacctgttcatgaagcgcgtgatggaaggcggcgagtggagcctgttctccccgtccgaaaccgccgacctgcacgacctgtacggccgcgccttcgaaaaggcctacaccgcctacgaagcccgcggcgagcgcggcgagctgaaagtctacaagcgcatcccggccctgagcctgtggcgcaagatgctgaccatgctgtttgaaaccggccatccgtgggtgaccttcaaggatccgtgcaacatccgcagcccgcagcagcacatgggcgtggtccacagctccaatctgtgcaccgaaatcaccctgaacaccaacgacgacgagatcgccgtttgcaatctgggctcggtcaacctggcggcgcacctgaaggccgacggcagcctggacggcgacaagctgcagcgcaccatccgcatcgcgctgcgcatgctggacaacgtcatcgacatcaacttctatccggtgaagaaggcgcgcaactccaatctgaagcaccgcccggtcggcatgggcgtgatgggcttccaggactgcctgcacatcaagcgcgtgccctatggctccaacgccgccgtcgaattcgccgatgaatcgatggaaatggtggcctactacgcctacctggcctccaccgagttggcggaagagcgcggccgctacccgtcgtacagcggcagcctgtgggaccgcggcgtgctgccgcacgacagcatcaacctgctggcggccgagcgcggcggctatctggaagtggaccgcaccgaacgcatggactggaacctgctgcgcgaccgcatcaagcagttcggcatgcgcaacagcaactgcctggccatcgcgccgaccgcgaccatcgccaacatcatcggcgtgtccgcatccatcgagccgacctaccagaacctgttcgtgaaatccaacctgtccggcgaattcaccgtcaccaacgaatacctggtgcgcgacctgaaagccgccggactgtgggatgaagtgatggtggccgacctgaaatacttcgacggcagcctgggccagatcgaccgcgtgccggccgagctgaaagccatctacgccaccgccttcgaactggatccgcgctggttggtggaagccgcttcgcgccgccagaagtggatcgaccaggcgcaatcgctgaacctgtacatggccggcgcgtcgggcaagaaactggacgagctgtacaagcacgcctggatcaagggcctgaaaaccacctactacctgcgcaccctggcagccaccagcgccgagaaatccaccggccgcggcggcgagctgaacgcggtgtccagcggcaacagccagcaggctccggccgccgaggtggacaacaccccggccaccgacgccaagttctgcagcatcgacaatccggactgcgaatcctgccagtaaggcggaaccctcgccccaagacaaacggctaccctgatgggtggccgtttttcattcatggcccgcagcgcctgccagaacgctgcgcggcgatagtgatgcggcaaagcccaaaaattcgcgcctgccgccgtatcggcatgaacagcctagtcttacatgcccctttcgcttctcccgcagccatgccgaaccggcatagcccgcgccaagccaggcttccgccggcatcctcttcccgccggctctgcaatcgcgacacaagattcgcttaatcacgcggagcctgtcactccgccgctggcgcggcgccgccccgaaaataatgacattgtaatttaaattaaagatcaaaataataaatgtctgctctttaatttaaatgattaagacaatgcttcattaaaatttcaatacaaaaacgcttagccataattagagcatttctaccacaccacccctgtcctaaagcacagccaaactgacgtcaaactgtcacttctccagtcatggccgccaagcctacctaactcacatcgatttcaacacatcagcaaaactagatatttccttttttatcaatgatctgtatgtccaaccatggacattcacgccacgccgcgcaatgagatcgtcatgaaaacaggggaattacaatgtcgtacatacctgttttggcatgcggtatcatttactcgtcattggcagaaaatttaatgctgaaaacaaaaaatagtacaaagtcatttttatgcagccaagccacaaccctatttgaccgcaatgagataaagcaaagaaataaattcatcgaaaaaacaatttgaataaaaacaatatcaggaagaagcaaaccggatcaccccttttactatgccgctagcaaatcggcccaaataatggcgcaatcctcatgaaccatccgcaaccgtcccaaccgaccagcgcttcggaaaatcgcctcctcccgtcgcgccaaccagaacgcgtcgccatcatcggcgcagcttgccgcttccccggcgccaacagcctccaggcgctcagaaacctgctgctggaagaacgcgaagccgtggaccagatcgccatagaccgcggcgccatcgccgccgacggcgtgagccgggccggcctgatcgacccgccggatggtttcgacccgcctttcttcggcatcgcccagcgcgaagccaatcagatggacccgcagcaacgcctggtgatggagctggcggtggaagcgctggagtccgccggcatcccgcgcgccagcctggccggcagccgcaccggcgtctacatcggcatctccactttcgactacagccggctgcagatgaacgaaggccaggatctcgacctgtacgccggcaccggcaacgccttcagcatcgtcgccaaccgactgtcctacttcctcaacctggccggccccagcctggcggtggacaccgcctgctcgtcgtcgctgaccgccgcccacctcgccgtccgcgcgctgcgcgccggcgaaatcgacctcgccatcgtcggcggggtcaacctgctgctggcgcccgacctgatgaaagtgttcgccggcgccaagatgctgtcgcccgacggccgctgcaagactttcgacgccgccgccgacggctatgtgcgcggcgaaggcgccggcatcgtcatcctcaagcgcgccagccagctacagccggagagcgaacgcgcgttggcgctgatcgcaggcagcgcggtcaaccaggatggccgcaccaacggcctcaccgcccccagcggcccggcccaggtcggcgtgatccgcgacgcgctggctgacgccggactgctccccgccgatatcgacgcggtggagttgcacggcaccggcaccccgctgggcgacccgatcgaagcccaggcgctgggcgaggttttcgccgcggatcgcgaacaaccgctggcggtcggctcggtcaagaccaatatcggccacctggaggccgccgccggcatcgccggcctgctcaagggcgtgatcgccctgcgcgaggccaagctgcccagctcgctcaacttccgccaggcgaatccggacatcgacctagcgcggctgaagctcgccgtcgccagcgcgccggtcgcgctgccgtccgcgcgccgccccgcccgcatcggcgtcagcagcttcggcttcggcggcaccaatgcccacctgatactggagaccgccccggcgcaaccgccgcggacggcccatgccgacgatgccgccagctggctgctgccgctgagcgccgcctccgccgacgccctgcgcgcgcaagccgcccaatacgcggcgctgctggagcgatccggcggcgccgcgctggccgacatcgtccacaccgccgcgcgccaccgcgaccatatggaccaccggctggcggctcatggcgatcgcggccagttgatcgccgccctgcgcgccgcggccggcggccagacgcatcccggcttgtcgctgggccgccgcccggccgccggtgcccgcaagctggcgctgcatggcgctgcgccggaactgcgcgcagcgctcgcccaagccggcatcgccgcggacgccgaactggagagttcgtcgcccgaggcctggcaacagcagttgccgggccgctgggacatcctcgcgcccagccatggcgaagccgccgcgctgccggaaaggcttcggccgctggccgctcccgccgacgccatggccgcgctcggcctgctctacgcctacggccacgaactggactggcagcggatccagccggccggcgcgctggccgaactgcctgcctatccgtggcagcgccgccgctgctggtacggcgaccaaggcctggccgcgcgcgtcaccgaccgcccccgccatctgctcgctctggccgccgccagcgccgaagcgctgtccagccaagccgcgcaagcgctgcaagactgcgcccaactgccgcccgacgccttggccgacttctgccatgccgccaacgccggtttggccaagcagccctggcgcgccagcgtcggcgccgccgactccgaagaattgcgccgcggcctgcagcaactggcctcccggccccagcccgcgcccgcgccggccgccgagcccggcgtggtgttcctgctgaccggccagggcagcgcgctggccggcgccggcgccgaactctatgccagccatccccgcttccgcgacgccatcgaacactgctcctccctgctcaagccggtgcttgacgtttccttgtcgcggctgctgttcgaccgcgtccgcggcgacgcgctgctgcagaacacctgctacgcgcagcccgcctgggtggcgctcagctggtcgctggcccagctgtgggccgactggggcgtgcgcccggcggcgctgctgggccacagcctgggcgaatacaccgccgcggcgctgtccggcatggcatcgatagaacagatcctgccgctggtggcggcgcgcggcgcgctgatgcaggaaaccgccggcgcggccggcatggtcgcggtgaaggcttcggcggagcaactgcgcgagctggtcgccccccatgccggcagcctggcgttggccgccgacaacggccccgccagctgcgtgctgtcgggcgcgtccgacgcgctggccgaggcgctgaaggcgctggacgcccaaggcatacgctggcgcacgctggacgtctccaccgccttccattcccctctgctggacccggtgctggagcggatggccgcgctggccgcgccgatagactggcagcccggcacggtgccggtgatttccaacctcaacggcctggcgcacgcggcagcgcccgacgccgcctactgggcggcgcatgcccgcggcaccgtgcagttccgccagggcgtgcaaaccctgctggcgcaaggccacaggctgttcctggagctgggcccgcggccgacgctgagcgcgctgggccgcgccgccagcggcgagctggccgtcaactggctcagttcgctcgacggcgccggcaacgattggcaagccatgctcgacagcgcgggcgcgctgcacaacgccggcgtcaaccttgactggagccgcttcgaccagccctaccgccgacgcgccctgccggcccccgccgcccgatcctccattccatcttcgctggagccatccatgccacaagtcaacagctctctggatccccgatccaatccgtcgacctccgacgaccacgtgcggcaagtccgcgccgacctggtgcggcaaatcgccaaggcgctgggagagtcggaggccgacctgcaaaccgaccgcctgttcatcgaaatgggcgccgactccgtgatgctggccgaggcgatgcgcggcatccaggccagctacggcgtcaagatcagcgcccgccagctgctgaacgaactgaacaccatagaccgcctcagcgtgcacctggccgagcaaaccgcgccgcaggccgccccggcggcggccgcgcctgcgccggccatcgcgctgccggcccacgccgcggcgggcgacatgaacgcgctgttccagcaacagctgaacctggtgcagcaggtgatccacagccaattggccgcgctgggcggcgcgccgcaagccgcgccggcgccgattcgcccggtggccgcggccatcgccgccctgccggccgcgcccagcagcatcccggcggcaaaagccgcgccggcccgcgccgccggctccgcccagtcccagcagcaggccgcccactttgccgccttttcccaggcctacatcgcccgcaccgccacctccaagcgcctggccgacgaacgccggcagcggctggccgacgtgcgcgcctccgccggcttccgccccacattgaaggaaatcgtctacccgctcaccggcaaccgcgccgacggcgcccgggtctgggacgtggacggcaatgagtacatcgatatctcgatggacttcggcgtcaacatcttcggccatggcgcgcctttcctgaaagcggcgctgcacgagcaagccgaaaacagcctggcgctcggcacccgctccaccctcgccggcgaagtgtccaccatgctgtgcgaaatgaccggcatggaccgggtcctgttctgccagtcgggcagcgaatcgctgatgacggcgctgcggctggcgcgcctgttgcgcgaccgctcgcgggtggcggtgttccgcaagtcctaccacggccacttcgacggcctgttgggagaccgctccgccatcggcgacgccaccgagccggtggcgcccggcatcctccccaacttcgtcgccgacctgctgatgctggactactgcgacgacgccgcgttgcaggcgattgaagccaacgccgatcaactggccgccgtgctggtggagccgatccaaagccgcgtgctggacgcccagccgcgcgaattcctgcacaagctgcgcgaagtcacccgccgccacggcatcctgctgattttcgacgaaatgatcaccggcttccgctgcgcccccggcggcgcgcaggaagtgttcggcgtggaggccgacctggtcacctacggcaagaccataggcggcggcgtgccgatggcggcgctggcggcgcgcggctcgctgctggacggcatagacggcggcatctggcgcttcggcgacgactccgcacccgacgccggcaccaccttcttcgccggcaccttcaacaaccacccgctgggcctggcgatggcgcacgcggtgctgaaggagctgaaacagcgcggcccggccttccagcagtcgctgaccgaacgcacccggcagctgaccgaacgcctcaaccagtacttccaggccgagaagctgccgctgtcgatgatccacttcggctcggtgttccgcttcaagcacgccggcaatctggacctgttctactaccatctgctgcaccgcggcctgttcgtctgggaaggccgcaactgcttcctgtgcgacgcgcacggccaacaggagatcgacttcatcgtcgacagcgtgatcgattccgtcgaagccctgcgcgcaggcggctacctgccggcgcgcccggccggcaccggcctcgccgccggcgaagcgccgctgtccgacacccagcgccagatctggctggcttcgcagctggacgcctccggcgccgccgcttattgcgaaaccgtcgcgctggagctgggcggccgcatcgaagccgccgcgctccaacgcgccctggccgagctgtcggcccggcacgaggcgctgcgcaccaccgtgcacggcgacaagggcatccagcgcgtccacgccgaactggccatcccgctgacgctgggcgaaggcggcgacggcgccgactggctgcgcgcgttctccgccacgcccttcgcgctggaaagcgccggcccgctgcaagccggcctgttccagcttgccgacggcaagccggtattggcgctgcgcgcccaccacatcctgatagacggctggtcgctggcgctgattctggaagagctgggcgcgctgctggacccggccggccgcgccgcgctggaagcggcgcagccgttccgccgccagctggaatggctgctgtcggcgcgcgacgagcaggccgaagccttctggagccaacgcctggccgacgcgccggaagccttgccgctgccgcgcgccaacgccggcgacgatggccagcaggcccgctggcagggcgagcggctgcggctgccggtgccggccggcaccgccgacgcgctgacccagctggccgtgcggcagaaggccacgctgttcaccacaacgctcagcctgacgctggcgctgttccacaccctgttcgaccgcgacgacatcctgctgggggtgccgacccacggccgcctcgacggtctggagcgcatggtgggccaggcggcccagatcatgccgttgcgctcgcgcctcgcgcccggcgcgcgcttcgagcaactgctggaaacggtggactttgaactggaggcgatgtccgaccaccaggcctacccgctggcgcgcctgctggagccggtgctggccggcggcgagcgcccgggcgcgctgaccgtcaccttcaacctcgaccgcgtgcgccagagcgatttcgccggcctgccggtcaccttgctggacgcgccggtgtccggcgtcaagttcgacctggcgatcaacctgatgcagacgcccaagggctggctgctggacctggactaccagagccgccgctaccgccgcgaagacatccagcggctggccgagcgctggctggactgggccgcgcgcgtcgccgccgacccggccgtcgaactggagcgcgccaacccgctgccggccgccgagctgcagcaggtgctgcgcggcttcaacgccaccgccaacggcaaaaccgcgctgccggtgccgcaacgcatcgcccgccaggcggcgctgacgcccgacgccatcgccatcaccgccgacggccgccatatcgactaccgcacgctggacctggcggcgcgcaccatcgccagcgaattggtcaaccacggcgccggcccggagaagatcgtggcggtgatgctgccgcgctcggccgaactggtggcctccctgctgggcatcttctacaccggcgccgcctacatgccgatagacccggacgaaccggcgctgcgccgcgaggaaatcttcgccgagacccagcccatcgcgctggtgaccgatgccgccatcgcctcgcgcctggcggtggactgcccggccatcatcgtcgaatcgccggaagagctggccgccggctggcccagcaccgccgatgcctgggtcaacccggcacccgtcgaagccggcgacctggcttacgtgatctacacctccggctccaccaacaagcccaagggcgtgctatgcacccatggcggcctggccaacctgatggagtggaccaccgagcgcttcccgctcgacgccgccgacgcggtgctgcaaaaagcgccgtacaccttcgacatctcgctgtgggagctgtgctggccgctgctgaccggcgcccgcctggtggtggcgccgccggaaacccaccgcgatccggactacctggcccggctgatcgccgctgaacgcgtcaccgccgcgcaattcgtgccggcgatgctggaagccttcgccgccaccccggccgcgcgcgaatgccgctcgctgcgccacctgttcgccggcggcgaggcgctgctgccttcgcaatgcatcgcggtgcgcgaactgggcttgccgggcctggagctgcacaacctgtacggccccaccgaagccaccatcctggtcacccattacacgctgcgcgccggcggccgcggcgcggtgcccatcggctacccgatcgccaacacttcgctgcgcatcgtcgacagccgcggccgcccggtcggcgtcggcatcgagggcgatctgctgatcggcggcgtccagctggcgcgcggctacctgaaccgtccggagcagaacgccgccgccttcatcgaaaccgtagccgacgacggcgcgccgctgcggctctatcgctccggcgaccgcgcccgctggctggacgacggcgccgtcgaatacctgggccgcgtcgacaaccaggtcaagctgcgcggcctgcgcatcgagatcggcgagatcgagcacgcgctgcgcgcccacccggccatccaggaagcggtggtggacctgcgcggcgacagcgccgccacccagcggctgctggcctggatcgtgccgcgccagcaggcagaagccctgccggccggcgactggcagcaggcgctgcgcgaatacctggcgcaaaggctgccgatctacatgatcccggcgcaattcgccgcgctggccgcgctgccgctgagccgccacggcaagatcgaccgcggcgcgctgatcgagccgcgccccgacgccggcgccgtccaggcgccgcgcaacccggtggaagccgagctgctcgactacgcgcggcagaacctcgcgctggaaatggccggcgtggaggacaacttcttcgtcgccggcgggcaatcgctggccgccgcgcaactggtcacctgggcgcagcagcgcttcggcgcgcgcctggcgctgaaggacttcctgctgaagccgacgctggcgcagctggcgctgctgatcagccaggctgggccggcctccgctgacgacgaaggcggcttgcgcagccgcgaacgccgccgcgtgcgccgcgatcagatcgaaaacgaaaccctgggcggcgccgacaaatgagcgctcatcaagacatgacaggcaaggcaacggatatgcaagacaacagcatggctcacgaagttttcctgtgcgacgcgtcggcggcgcaacaacgcttgtggctggtatgcggcctggagggcgaacgcagcaactacaccatcgccggcgcgctgcgcctgtccggcccgatgcggcccgaggcgctgcagcaggcgctggacgactgcctggtgcggcacgaaaccctgcgcaccggcttcgtcgacgtcgacggcgtgccgatgcaggcgatcgaacccgccgcctcgctgccgctggcgcgcgtcgatctgggcgcgctgcccagagaagaagcgctgcgccaggccatggacgccgccgccgagctggcgcgccgccccttcgcgctggaaaagccgccgctgctgcgcgcggcgctgttccgcctggccgacgacgactggctgctggcgctggccatccaccacatcgtctgcgacggcccgtcgctgggcctgctgatgcaggacctggcccgcgcctacgcccatcggcaagacccggcccagccggcgctggccgagctgccgctgcagttcgccgacttcgccgaatggcagcaggagcagctggccagtccagccagcgaggcgctgctggcggcctgggaagcgcggctggccggcgtgcccgatctgcagccgccaaccgacttcccccgccccgcgctgcgcgaggccaggggcgcgcgccatgaggcccatctgcccgccgccgtccgcgacgcgatggccgcgcttgcgcgcgagctggaaaccacgccgttcgccgtgctgctcgccgcttggggcatgaccctggccggctggagcggccaggacgatttcgccatcggcagcccggtcagcgcgcgcaacgaccccgcgctggccgaagtggtgggcatgttcgccgaaacctcggcgctgcgcttcaagctggagggcgaccccagcgtcgaccaggttctgctctccatgcgcgacgtctggcgcgattcgctggccttctccggcgcgcctttcgaccgcctggtgcagcgcctgcgccggccgcaggaccgcagccgcacgccgctgatccagaccatgttctcgctgaacccgccggcgctgccgctggacatggccggcctgcaagccgaaacgctatcgttgccggacggcgacgccaaggccgacctgtcgctggaagtcgacgaaaccggcgatggctacgcgctgacgctggactacgacggcgcgctgttccgcgccgaaaccatcgcctggctggccgagcgttacgccgccctgctggcgcaactgcccgccgcccgcgcccagcccttgcgcgccctgctcgccgccgcgccggcccagcgcctggccagcgacgccgagcgcgaacagctggaccgtttcaacgacaccgcgctcgcgttgcccggcgcgccgctcctgcatgcccagctggcccgccaggccgcgcaaacgccggccgcgccggcgctgtggcatgacggcaggcaaatggacttcgccgagctcaaccgccgcgccaaccggctggcgcatcatctgcgcgcgctgggcgtgatgcccgacagccgcgtggcgctgcatttcgagcgcggcttcgaccagctgatcgcgctgtgggcggtgctgaaggccggcggcgcctacgtgccgctcgacccggtctacccgcaggagcggctggaattcatgctcgccgacagcggcgcgcagatcgtgctgaccgaaagcgagctggcgccgcgcctggccggcgccgccgcgcgcgttctggcgctggattcggccgagctcgccgccgcgctggcgcagctgccggacagcgacccggacgacgccgagatcggcctgcgccccgaccacctcgcctacgtgctctacacctccggctctaccggccggcccaagggcgtgatggtggaacaccgctcgctgctcaatctgcaggcggcgttgcagccgctgctggccgcactgccgccgggcagccgccacagcctgaacgccccgatatcgttcgacgcctcgctggagccgctgctgcagctgctgagcggccactgcctgtacatcatccccaacgagctgcgcgccgacgcgccggcgctgctggccttcatccgcgaacaccggctggacgcgctggactgcacgccggcgatcatggagccgctgctggccgccggcttcggcgacggcggccacgtgccgcgctgcgtgctgatcggcggcgaagccatttccgagcacacctggaaccggctgcgcgccatcgacgattgcttcatctacaacacctacggcccgaccgagtgcacggtggactccacctactgcgaattgcacgaggccggcgacatgccgcacatcggccggccgatggccaacacccgcgtctacctgctggacgaggcaggccgcctgctggcgccgggcgaagtcggcgaactctatatcgccggcgattgcgtgacccgcggctatctgaaccggcccgagctgaacgccgaacgcttcctggccgaccccttccgcccgggcgagcgcatgtaccgcagcggcgacctgggccgctggctgcccgacggctcgctgcaatatctgggccgcaacgacctgcaagtgaagatccgcggccagcggctggagctgggcgagatagaagcccagctgtgccgctgcgacggcgtgcgcgacgcggtggtggtcgtgcgcgaggacaccccgggcgacaagcgcctggtggcttacctggtgccggcggccggcgccgcccccaccgccgcgcaactgcgcgaagagctggcgcgcaccttggctgaagtgatgctgcccagcgccttcgtcaccctggacgcgctgccgatgacgcccaacggcaaggtggaccgccgcgcgctgccggcggtcggccagcaagacctggcgctgcaggcctacgaagcgccgcagggcgagattgaaaccgccatcgcagaattgtggcaggagctgttcgccatcgaccgggtgggccgccacgacgatttcttcgcactgggcggccactcgctgctggccacccgcgtcgcctcgcggctgggcaagcgcttcggcatccgcctgccgatgaccacgctgttcgattcgccggcgctgcgcgcgctggccgcccgcatcgaagcggcgcaggcctcgctgcgcgcgccggccgagacgccggccgccgcgccggtcgacgccgcagccggcgcgccgctgtcggctgcgcaaaccggcatgtggttcattcaccaattggcgcccgccaacaccgcctacgtgctgtccggcgccatccgcatcgacggcccgctgcagcccgaattgctgcggcgcacgctggacatcctgctgcagcgccatgaaatcctgcgcagccgcttcgaccagatcgacggcgaaccgcgccagtttgcccagccggccgcgccgctggccttgccgctggaagacctgagccaactggacgaggacgcccgccagcggatgctgcgcgcccggctggaggccgaggcccgcacgccgttcgacctgacccaggcgccgctgctgcgcgcgcggctgttcgcgctggcgccgcaaagccacgcgctcagcctgtcgctgcaccacatcgtcgccgacggctggtccatcggcatcctgtggcgcgagctggcgcagatctacgccgctctggccgccggccgggctccggacctgcccgccgcgcccagctacgccgactacgcccgcgccgaggccgcccgcctgcgcgacgagcaaagccaggacgatctcgcttactggcgccaggcgctggccgacgtgccggcgctggagctgccgctggaccacgcccgtccgccgcaaaccgacaacgccgccgccgaataccgcttcaccctgccggccgcgctgcgcgcccagatggacaagctggcgcaacaggccggcgccagccgcttcatggtgatgctggcggcgttccagatgctgctggcgcgctggagcggccagcgcgacttcgccgtcggcgtgccggtgtccggccgcgacggcctcgacgtgcacgacacggtcggctgcttcgtcaacacgctggcgctgcgcgccgacctgtccggcgactgcggcttcctgtcgctgctggagcgcgtcaaggcgagcagcctggcggcgttcgcccaccagggcctgccgttcaagcgcctggtggacgagctgcgcccggcccacgacgccgaccgcacgccgttgttccaggtgctgttcaactaccagcacaccgaccacggccgccacgcggtggaaggcctgcaaatggagacgctggcggtggacgccggcgccgcccagttcgaactggggctgtatgtggaggacgacgggaccgacatcgtcgccagcctggtgtaccggaccgacctgttcgcgccgcgccacatcgcccgcatgggcgcggcgctgcagatgctgctggaggccggcgccgacccggcgcgctcgctgtggctcgcgcccatcgtcaacgaccacgaccgcgagctgatggcggcctggaaccacaccgacgtcgacttcggccccgccgtccacatcgacaccctgatcgccgaacaggcgcggcgcaccccgcatgcctgcgcggtagaagccgaggacggcgcgctggactacgccgcgctgatggcgcgcgccgacgcgctggccgtccgcctgcgccggctgggcgccggccccggcaagctggtggcggtgcatctgccgcgcggccaggacctgccgatggcgctggtcggcatcctgcgcagcggcgccggctacctgccgctcgaccccgacctgccgcatgagcgcctgtcctacatcgtcgaagacgccgcgccggtcgccatcgtcgcctatccgggcagcaccggctggctgagcgccccgctgccggaggtcgtcccggtggacgaggccgggcctgaaaccgaagcgctgccggcaatcgcgcgcagcgtcgacgacctggcctacgtgatctacacctctggctccaccggcaagcccaagggcgtgctggtgccgcacgtcggcgtggtcaaccgcctgctgtggggccagtcggccttcggcctggcggccggcgacaaggtgctgcagaaaaccagcgccagcttcgacgtgtcggtatgggaattcttctggccgctggccaacggcgccacgctggtgatggcccgccagggcggccagcgcgaccacgaatacctgagcgcgctgatcgagaaaagcggcatcacccacatgcatttcgtgccgtcgatgctggccatcttcctggccgaggtcgacgccgcgcgctgcgcctcgctgcgccaggtgttcaccagcggcgaaacgctgccgccgcagttgcgcgatcgtttccacgactggacccgccacgcccggctgttcaatatgtacggccccaccgaaacctgcatcgagatgaccatgtggccgtgcgcgccgatcgagcgcggccagccgctgcccatcggccgcccgatcgccaacagccgcgtccacatcctcgacgaaaacggcatggagatgccggtgggcgtgcccggcgaaatctgcatcgccggcgtccaggtggcgcacggctacctgaaccggcctgaactgagcgccgagcgcttcctgcccgacacgctggaccaccgcccgggcggcctgctctaccgcagcggcgacatcggccgctggtgcgacggcggctggatcgaatacgtcggccgccgcgacaaccagatcaagctgcgcggcttccgcatcgagctgggcgagatcgaatcggtgctgcgccagcatccgggcgtcagcgacgccaccgtgctggtggccggcgccgacgccgaatcgcagcgcctggtcgccttcctgctggcgccggacggcggcatcgacgtggccgcgctgcgccgcgagatcgcctcccgcctgccggaaatcatgatcccgtcaaccatcctgccgctgcccggcttcccgctcaccagcagcggcaagaccgaccgccgcgccctgctggcccagctggcgcaagcggcggcccccgccgccggccatagcccgctgggcgaggtggagcgccagctggcagcgatctggtgcgaagtgctgggtctcgcctccatcgacacccgcgccaacttcttcgaagccggcggcaattcgctgctgatgatcaaggtgcattcgcggctgaaggccttgtaccagccggccccggcgctggtggatctgctgcgccacccgaccatcgccgcgctggccgcccacctggcccccggcggccaggaccaggccgcgccgctggccgccgcgccgcgccgcgccgaaggcgacgacgccatcgccatcatcggcatggccggccgcttcccgggcgcagacagcgtcgaggcgctgtgggacaacctgctggccggccgcagcggcgtgcgcgagatcagccgcgaggaagccctgaccgacggcgccgacccggcgctgctggaccatcccggctacgtgcccttctccggcgtgctggaaggcatagaccagttcgacgaaaagctgttcggctacagcccggccgacgccgcgctgatcgacccgcaaggccggctgctgctggaaaccgcctgggaggcgctggaaagcgccggcctcgacccggcgcgcgccggcggccgcatcggcatgttcgccggcggctcggtcagcacttacgcgctgggcgcgctgaaaaacctcacgctggccgatagcgagctgctgcgcgcgctgttctccaacgacaaggactacctggccagccgcgccgcctacaagctgggcctgaccggcccggccatcggcgtgcagaccgcctgctccacctcgctggtggcggtatcgctggcgatacgctctgtgctgtccggcgaatgcgacgccgcgctggccggcggcatctcggtggccgtgccgcaacgggtgggctacctgtacgaggaaggctccatcctgtcgccggacggccgctgccgcgccttcgacaacgccgccgccggcaccgtgcccggcaacggcgccggcctggtggtgctcaagcgcctgtcgcgcgcgctggccgacggcgaccccatccgcgcggtgatccgcggcatcgccatcaacaacgacggcgacgacaaggtgggcttctccgcgccgtccatcgccggccaggaaaacgtgctgcgcgccgcgctgcagaacgccggcctgcgcggcgaggacatcggctacgtcgaaacccacggcaccggcacccgcctgggcgaccaggtggagctgagcgccctcaacgctgcgctgggcaaggacggcggcgcctgcctgataggctcgctcaagtccggcatcggccacctcgacgccgccgccggcgtcgccggcctgatcaaggcggcgctgaccgtggagcgcggcgtcatcccggccagcctgcatgtcgaacaaccgaacgcgctgctggccgaaaccgccagccgcttccaggtggccaccgccgcccaggactggcagccggacggccgtccgcgccgcgccggcgtcagctccttcggcattggcggcaccaacgcccactgcatcgtcgagcagccgccgcgcaccgaggcggcggcgatccagaccagcgcgcagctcctcacgctgtccgccaacgacggcgccagcctggcgcgcctgagcgagcgcttgcaaaccgcgctggcgcagcctggcgccgatctggcggccatcgcctggacgctgcagaccggccgccgcgaactgccgtggcgcttggcggtagcggcaagcgacgccgcctccgccgccgaggcgctggccgccgcgacgccgccgcgcgacgccgccgccgcgccggagctgtggttcgccttccccggccagggcagccagcgtgcggcgatgggcgcgggcctgttcgccgaagagccgctgttccgccagacggtggaaacctgcctcgcgctgctggaccgcgaactggccgccaccctgcgcgcggcggtgttctcgccgcagccgccggccgacgccgacgcgctgctggcccgcaccgacatcgcccagccggcgctgttcatcatggaatacgcgctggccacgctgctgcaggcctggggcctgcgccccagcgcgctggtcggccacagcctgggcgaaatcagcgccgccgcgctggccggcatgctgcaactgggcgacgcgctgcggctggtggcgctgcgcggccggctgatgcacgacagcccggccggcggcatgctgcaggtggcgctgtccgccgacgcgctgcgggcgatgctgccggcggagctggccatcgccgcctgcaacgcgccggagctgaccgtggtcgccggaccggcagacgcggtggaccgtttcgccgacgcgctacgcgggcaaggcatcgaccatcagcgcctggacaccggctacgccttccactcgcagttgatggaccaagccgcggcggaattctcccgccagctggacaacctgcagaccgccgctcccagccagcccatcctcaccaacctgagcggcggctggctgagcgccgaagacgcgctggacgccggccgctgggcgcggcagatccgccagccggtgctgttcgcccaggcgctggaacaggcgcggctgcgcggcgcgctggtgctggaggtcggccctggccgcaccttggccgccttcgcccgccaggccggcgtcgccgccgtcgccgcgctgccgcaagccggcgccgaaaacggccgccgcgcgctcttggccgccgtcggccagctgtggcaggccggttgcgcgccggactggcgcgcgctgcagcatgacgcgccgccgcgccgcgtgccgctgcctacctatccgttcaaccgcaaacgccactggctggcgcaaaacgccgccgcgccggttcaaggccgcagcggcgcgcacctggcgctgctggactggcgctacgccgaagcgccggagctgcggccgctgcgccgcgccgccatcctcggcggcgatgccgcgctggccggcgcgctggcggaaaagctgcgcgcccgcggcgtggaagcccattgctggcgcgagctgcccgcgcagcgcgacatagagcttctggtggcgctgacgcccgatttcgacgcgctggcgcggctggccgggcagctggccagccaaccggcccgcctgctggtggtcacccgcaacgcgcagctggacgacgaaaacgccgacgccgacgccgcgatgaccgccgccgccgcgctggcaatcggccaggagctgcccgaactgtcgctgcgccaggtagacctggccggcggcgatccggcgcggcggccgcgccaattggccgcgctggccgatgaatgcctggcctccggtcccgcggtgctggtgctgagcgacggccgccgccgcgcgcccagcctctgcccgctggatgttccggccgccactgcggctcaggcgggcgccgtcacgctgatcaccggcggcttcggcaatgtcggcatggccttcgcccgccgcctggccggcgccggcgccgccaaactcgcgctgctgggccggcgcatcccggccgacgacgatccgcgcctgctggaattgcgcgcgctgggcgccgaggtgctgccgctggccggcgacatcgccgaacccggcgtcgcccgccaggcggtggaagccgcgctggcgcgcttcggccggcttgacgcggtcatccacgccgccggcatcgccggcgacgccgcccaccgcccgatcctggaaaccgacgccgcggaaagcgccgccatctgggccgccaagcgcgacggcagcctccatctggccgaggcgctgcaaggcctgccgctggaccacgtgctgctgtgctcgtcgctgtccaccgtgctgggcggcctgggcttcgccgcctacgccgccggcaaccgctggctggaagtgttcgccgaacggcaaagccgcagcggcgacacccgctggctggcgctggccttcgacggctggcgcttcgacgagccggccggcaaggatgcggcgctgagcgcagcgcaaggcgtggcgctggccgaacaagccatcgccgccggactgagcggacgggtgctggccagcgccggccagctgcaggagcggctggcgcgctggacccagggcggcggcgaaaccgacgcggctcccgccgcgccggtggacatcgccggctacgccaatcccgccgaggccatcgtcgcgcagaccctggccgagaccctggccctgcccgccatcggcccggacgacaatttctttgaactgggcggcgacagcctggtcgccacccgcgtcatcgccaagctgcgcggcgccaccggactgccgctgtcggtcggtctggtgctgcaggcgccgaccgtgcggctgctggccgccgccatcgccgcgctgcaaggcggtgccgcagccgtcgccgacgacgcggaagaatacgaggagggagcactatgagcgccgaagcgatacgcctgctggccgaactgaacaccctgggcatcagcgtctgggcggagcaaggccaattgcgctttcgcgcccccaaaggccggttgaccgaaccgctgaaagccgaactggcggcgcgccgcgacgccttgctggcgctgctggacaaggacgcggcggcggaaaccgccatcgtccgccgcgacatgccagccggccagccggtgccgctgtcgccgcagcagcactcggtgtggatggccgaacaaaacggcggcggccacgccttcctgattcccggcgccctcagcctgcgcggcgcgctggacgtggatgcgctgcgcgccgcgctgcaggcgctggtgaaccgccacgaggcgctgcgctgcgcgatcaggctggtggacgacgtcccgatgcaggtggcgttgccggacgtgcgcttcgagctgccgctgaccgacctgtccgcgcaaggccaggccggccgcgaagccagcgttgcggcgcagctggccgccgaagccgagcaggccttcgatctggctacgccgccgctgctgcgcgcccgtctgctgcgcctggcggccgacaaccatgtgctgatcctgacgccgcaccacatcatgtccgacggctggagcatagacatcatggtgcgggagctgagccggctctaccgtccggactccgcccccgccgacctgggcccggttccgctcggctatcccgacttcgcgctgtggcaggacgcgcgccgcagccagggcggcgaccgcgccgatctggactactggcgccgcgcgctggccgacctgccggcgccgcttgagctgcccagtgaccgcgcggctgcgcccgatgtcgatttcgccggcgccgagctgcacgccgaactgccggccgccaccgccaacggcctgcgccagctggccaagcagagcggcaccacgctgttcagcgcgctggccgccgccttcgccgcgctgctgcaccgctacaccggcgaaaccgacctgaccctgggcaccgccatcgccggccgcagccgcgccgagctgcaagacgtgatcggcctgttcgccggccgcctgccgctgcggctggatctggacggcaatccctccttcctgcagttgctgcggcgcgtggccggcgccgcagccgaagccttctcccacgccgaggtgccggccgaacgcatcctggccgaagccgtggcgcccgatgcccggccggcgctgttccaggtgatgatcgcgctgcagaacgcggtgaaaaaccggctggacttcatcggcctggaagtccagccgctgccgatcgccggccataccgccaagttcgagctgttcctggcagtggacgaagccgacgaccgcctggcgctggcgctggagtacagcaccgcccgcttcgaccagccggccatgcggcaattgctgaatcacctggtgcgcctggccgccgccgcggtggcggcgccggagctgccgctgtccgaactggccatgctggacgcggacgagcgccgggctctgctggccccgccgcgcagtcctaaggcctgggacggtgccggcgatctctggcggcgcttcctgcaggcggccgacgcccatcccgagcgccccgccctgacgctgcccgcgcaatggcagcacgccggccccgacactgggctcagctacggcgcgctgcgcgaccgggcgcaagcgttggccggcagcctgcgccgcgccggcgtccgtccgggtgaaatcgtcgcgctggccggcgatcgctccggcgacttcatcgtcggcatgctggccatcctggccgccggcggcggctacatgccgctggcgcccgacctgccgccgtcccgcgtccaggaaatgctggaagattccggcgcggcgcgcctggtgttcagcgacgacgccggcgccgcgctggccggcagcttcgccgcggccttcgacgcccgcgccgccgcgaatggcgatgatggcgccgaactgcccgccatagaccccgcctcgcccgcctacgtgatgttcacctctggctccaccggccgccccaagggcgtggtggtcagccacgccaacgcgctgcatttcgtcgccaacatgccgaccacgccgggcagcggccgcgaagttttcctgcagttcgcgccgtccggcttcgacgcgtcggtgatcgagatctggagcgcgctgttgatcggcgcccggctggtgatcgccccgcccggcctgcccagcctggacgcgctggctgaattgatcgagagccggggcgtcaatgtctgctggctgaccgccggcctgttccaccagatgtgcgaggcccatccggcggcgctgtcgcggctggactacctgctgagcggcggcgacaggctgtcggtggccgcggcgcgcgcggtgctggcgcaaaacggcccggcgcgggtatacaacgcctacggcccgaccgaaaccacggtcttcgccaccctccaccgcatcctgccggccgatgtcggccccgacgcccgctcggtgccgctgggcggcgcccacggcgacgccaggctctacatcctggacagccggcgcgagccggtgccggccggcgccgccggcgagctgtacatcggcggggccggcgtctccgccggctacatcaatcgcccggacctcaccgccgaacgcttcctccccgatccgttcaacgccgcgcccggcgcccgcatgtaccgcagcggcgacctggtgcgccggcgcgccgacggtttgctggaattcatgggccgggccgaccgccaggtgaagatccgcggcttccgcatcgagcccgcggaaatcgaagcgcatctgcaggagcacccggccatctcgcaagcggcggtggagccgcaaaagcaaggcggcatccagcgcctagtggcctacgtggtggcgtccgcgccgctgagcctggacgatatccgcgatttcctggccgaacgcctgcctgaacacatgatccccggcgcgctggtggcgctggacgcgctgccgctgacccgcaacggcaagctggaccgccgcgcgctgccgcagcctgccgtggaaagctcggccggccaggagccggccagcgccgaagcgcgcctgctggcggcgatctggcgcgatgtgctgcaggcggagcgcatcggcctggacgacaacttctacgagctgggcggcgactccatcatggcgatgcaggtggcgatgcgcctgacccggcaagagtgggaactgcggccgcaggacatgctgcgccatcccaccttgcgcgcgcaaagccgcctgctgcgccgcaaggcgaaaaccctggcccggcgcgagttctcgcagccgctgccgctcacgccgatccagaactggttcttccagctgccgctcgccaaccgcaaccactggaaccaggcgctgcggttggcgctggagccggccgcggccgagcgcctggaaaccgcgctggccgcgctggagcaaacccacgacgcgttgcgcctgcgcttcagccccgatgccggcggctggcgccaactgcccgcggccgccgccagcccgcgcttgcgccgcgagcgggtcgccggcgaggaacaggccggcgaacgcatcgccgccgcccagcgcagcctggacatcgagcatggcccggtatggaccgcgctgctgctggagggcctgggcgactggccgcagctggtgctgatcgcccaccacctggtggtggacggcgtgtcctggcgcatcctgctggaagacctggcgctggcgctgcaaggccgcgcgctgacgccgccggcgctgggcctgtgcgactgggccgcccacctggcggaacagccggacgccgagccggacgccgagccggccgccgccgaaaccgctcccgccctgccgccattggaccatccgcaaggcggcaatctggaatcgcaaaccgccatcgccagcctgctgctgccgccggatgccgctacccagttgctggggccggccaacgcgccctaccgcaccgagccgaccgagctgctgctggccgccatcatgctgggcctgcgcgacgccttcggccgcgacgcgctgacggtggcgctggagcggcacggccgcgaggcggacggcatcgacctgtccggcacagtcggctggttcaccgccatcgccgcggtgcggctggatctcgccgcggcgcaaacgccgggccaggccttgctggcagtcaagcaggcggcgcgcaccgcgccgcgccggatgcgcaatggcgacggccgcgcgccggcggtggcgttcaactacctcgggcgcttcgacaacaccctgccgccgggcggcccgttccggccgctggacgccgacagcggcgtctgcaccgatcccgccggcgcgcgtccctacgcgctggaaatcgtcgccagcgtcgacgccgacggcctgcgggtggacttccgccacagcgccgaacagttcgagcgcgccaccatcgccgcctgggtggacgccgcccgcgccaatctgctggccctggccgcgctggccgacgccgaaaccgccggcggccgcgccccctgcgacttcccgctgtccggcatagccagccagcgcgagctggacgatctgctggccgagcaccagctggcggcgccggcgctggacgacctgctgcccgtcagcgcccagcagcgcggcatgctgctggaaaatctggcccaccccggccgcggcatgcacgtcgagcaattcgtcgccaccttcgccggcccgctggagccggcggcgctagaagcggcgtggagcggcctgatcgcccgccacgaaacgctgcgcagcggcttcatctggcgccatgacggcgaaccgctgcgcgtggtgcatcgccaggccgccgccggctggcagcacctggactggcgcgccgacgccggcgcggaaagccggataggcgactggctggcggtcgacgccgccgccggcttcgccggcagcgccgcgccgctgcgtttcgccaccatgcgcctggacgacgagcgctggctgttcgtctggacctatcaccacgcgctgctggacggctggagcgtggcgcggctgctggccgaagtgctggagccggccagcggcaaggccgcccccgccagcgcgcgcgaccacgcccgctggctggccagccgcgaccgcgaggccgcggcggccttctggcggcgctacctggccgacgccgccacccccagcctgcccggccgccgcgatgccgaactggagccgggcgaaggctatgccgacctgcgccagaccctggacgccacccgcgccgaaaagctggaaaccctggcgcgccgccgccgcatcaccccggcgatgctggcccagggcgcctgggcgctgacgctggcctgggcctccggccaggacgatgtggtgttcgcctccaccgtgtccggccgccccaccgaaatagaaggcagcgaggcctgggtgggcctgttcatcaacagcctgccgctgcggctgacggtgcccgccgccggcgacgcctggcgctggctggaacagctgggcgacaacgccgccgagcgctcgcagtacgaatggtgcgccggcggcgacatccacgcctggtcggggctatcgctgggccgcagcctgagcgacaccctgatcattttcgaaaactaccccaacaccccgcagcagccggttgccgagggcggcgcgcgcctggtgtcggtggccggccgcggcgcccgcacccacttcccggtcacgctgctgatcatgccgggcgacggctggcgctgcgaattcgtctgcgacaaccagtacatcccggccgaggaagcggcccgcctgctggacgccttcatccgcctgctggccgcgctggccgacgaaggcgccgcgctggacggcgtgcgcgccgccctgccgccgcagccgccgcggctgtgccgccagccggaacgcgtggtgcagccgccgcgcaccgcgctggagctggagatcgccaagctgtgggaagacctgttcgcgctcagcccgataggcgcggacgacaacttcttcctgctgggcggccattcgctgctggcgctggacctgatggcgcggctgcgcgcccgcttcggccgccgcgtgccgttcaccgccttcctggccgagcctaccgtggccggcctggcccggctgctggccggcgacgagctgcaaggcggcgtcagcctgctgccgctggccgaccagggccggccgctgtacctgatgccgggcgccagcggcaacccgctggcttacctggagctggcgcaggcgctggaggggcgctacgcgctgataggcgcgcagccggacatggtggaccgcggcgcggcgctgacgatagaagccgtggccgccgacctggctcaggctatcgaacgccgccagccgcaaggcccggtgctgctggccggccactccttcggctccgccatcgcctttgaaaccgcgcggctgctggcccgccaggggcggaccgtgggcgcgctggtgctgatcgacaccccggtgccgaacggcggcgacgaattcgccggcttcggcgagatcgactggatcgtctccatcgccgacgccgccggcagctacttcggccagcctatcgacctcgcgccggaagagctggagccgctgccgtccgacgcgcgccgcgccttgatgctggcgcgcttccaggccgccggggccttgcccgccggcgcgtcgcggcaggtgatagacgatttgctggccacctatcaaaacagcatcgcggcgttttccgcctatcgcccggcctattgggacggcgcgctcagcgtgatccgcagcgaacaggaacacggcatcgacgaccccaccctgggctggggcggactgtgccgggaaatcggcatcacggcggcggcgccgggcgaccacatctctatggtggcctccgcccacgcggcggagctggccaagcggatcgtgctgtgcgtggacagcgcgctggaagcgggacaggcgcgagacaaggaggcggcggcgacagtgtgagcaccttacatccaggcagcacccaaaccaaaaaccagatttttccaattgcacaagagaaatggacatggcaagcaacactccgccccgcaaccaccacgccgcgccgatagcggtgataggcctggccgccctgatgcccaaggccaacagcctgagcgactactggaccaacatcctcaacgaaaccgactgcctggagcgggttccgtctagccgctggccgctggatgaatatttcgacgccgaccccgccgcgccggaccgcacctattccgaccgcggcggcttcgtgcccgacctggcgttcgacccgctgctgttcggcctgccgcccaatgtcctcagctccaccgacgccgcccagctgtacgcgctggcggtgggacggcaagcgctgcttgacgccggctacaatccggacccggccgggaccggccgcaagctgcccaacagccgctccggcatcgtgctcggcgtgtccggcaccaccatgaagctgacgctggaaatggccaagcgcagcgaaatccccaagtggatagacacgctgcgccaggccggcgtcgacgaccagctgatagacagcgtggcgcgcgcgatgcgcagccactaccccagttggaccgaagacaccttccccggctttctcgccaacgtcgtcgccggccgcgtcgccaaccgcttcggcctgggcgccgccagccataccgtagacgccgcctgcgccagctcgctggccgcggtgcggctggcctgccaggagctgcgcagcggcgccgccgacatcatggtcaccggcggggtggacaccgacaattccaatgtcgcctttctcagcttcagcaaaactccggcgctgtccaaaaccggcaaggtgcgctccttcgacgccgacgccgacggcaccatgatttccgaaggcgtgggcatgctggtgctcaagcggctggaagacgccgaggccgacggcgaccgcatctacggcgtgatccgcggcctgggcgcctccaccgacgccgccggcggcgccatctacgcgccgcgcagcgaaggccagatgcgcgcgctgcgcgccgcctacgccgacgccggcttcgatccgctgtcggtgggcctgatcgaagcccacgccaccggcaccgtggtcggcgacgcggtggagatcgaatcgctggaagccgtgctgggcgaggccgccgcgccgatcgcgctgggcagcgtcaaggcccagatcggccacaccaaggcggccgccggcgcggccagcctgatcaagaccgtgctggcgctctatcacaaagtgatcccggccacgctgaatgtgcaggcgcccaacgcgcgcctgaagcaggacggccccttctacctgccgcgccgcgcccggccgtggctggctcccgccaacggcccgcgccgcgccggcgtcagcgtgttcggcttcggcggcgccaatctgcacgtagcggtcgaggaataccaggacaagcaccccgcccccagccaccacgcggccgcgcccatgctgctgagcgccgacaccccggcggaactggcgcgccgctgccgcgaactggccgaccggctgcaagccggcgaccacagcgcgccgctgtggccggacgcgccgccgccagccgcggccgcccgcgtcggcctgttggcccgctcgctggacgccgcgcccgaactgctgaagagcgccgccgacatgctggacaagcggcccgaccaggacgcctggtcgctgcccaccggcgtccactaccgccgccaggcgctggcgggcgaagtggtggcggtgttcagcggccagggttcgcaaaccgtgggcatgggttcgcgcctgctgatagaccagccgcaagtccggcaatacttcgaagcctttgacgacgccggccgcgagcgcggcttcacgccggtgtcgcagctgatcttcgcgcccgacaccttcagcgccgagcgcgccgacgcccagcgcgccgcgctcacccataccctgtacgcgcaaaccgccatcggcgcttacagcatggccgcctactcggtgctgcgcgacgccggcctgcagccgaaaatggccctgggccacagcttcggcgaactgagcgcgctgtgggcggccggcgtgttcgacgacgccggctaccgcgccgcggtgctctcccgcggcgacgcgctgacccccccggccggcgccgacgccggcggcatgatcgccatccaggcatcggccgaacagctgcaggcgctggccgcgcaattgcccggcctccacctggccaaccacaacagcccgaagcagaccgtcgccggcggcgacgccgccgcgctggagcgcgccatcgccgaactggcgcgccacggcatccaggccacccgcatcgcggtggccgccgccttccacaccggccatgtcggctacgccgccgcgccgtggcaggcggcgctgcgcgacataccgctgcaggcccccaaaatgccggtgctggccaatctgaacgcccagccctacccggctgacagcgagggcatccgctcgctgctggcgcagcagccgttcaacgcggtgcgcttccagcagcagatcgaagccgcctaccaggccggcggccggatcttcatcgaaatcggcccgcgcgcgatcctcacccgcatggtcgacgacatcctcggcgacagggcgcacatcgccctgccggtggcgcacgacccggctggcgacgacggccggcaaatccaggaagcgatcctgcggctcgccgtgctgggacaggcgatgcgcctggcctcgccggccccgcgcaaaccggcggccagcccgctgtcgatacaagtaggagcccatatcatccgcaccgccaatcagccggcctggccggtagtcgacaaaaccgccgccgcgcccgctccgcagccggccgccgcctccgaacccgccgtcgacagcgcccagctgctggcccaggtgcaccagagcttcctgcagcagcaggccgagctggcgcgcatcctggccgaacgccagcccgcgccggaagtgctggcggaaatccgccgcgcccaggacaaggtgcacgcgctgcaccaggccttcctcgacagccagcgcccggccgccgccgcgagcgcggctcctcagccggtcgtcgtccaagcagcccccgccatcgcgccgccacaggctccggccgctgcgccgctggctgcccaagcggctccggtccccaccgccgcgccgtcggccgacatcagccagctgctgctggccaccgtcgccgacaaaaccggctacccggtggacatgctgtcgctggacatgcgcctggaagccgacctcggcgtcgactccatcaagcgcgtggaaatcctctccagcgtccgcgacgcattgggcgtctccgccgcctccgccagcgacgagctgcgcagcgccgccaccctggcggaaatcgccgccctgctgagcggctacgccggccaaaccgtcaccgctccagctccggcaatcgcgccggttcaggcccaagcggttcaagctccagcggctagcccggccgccgccgccgccccgtccgccgacatcagccagctgctgctggccaccgtcgccgacaannnnnnnnnnnnnnnnnnnnnnnnnnnnnnnnnnnnnnnnnnnnnnnccaccgaccggattggcaaggctatctagtttttcaagcgattttccacgatggcaatgcatatttaaccttatgattcccatgattaatttcttgttttttggcataatttatgcattttaattgatactttctcgaaaattttgtctcaaagggtggagtggttcgcaagcgggtcgatcatgatgatgtgccgctcatccacgctgtccagatactggtcggctggcgggatgggtgtggcatctcgcatgctggtcatgagtcttctcaataaggcatcttgcgccagtcggatggcaagaggttcgtctggcgcggtttcctgcagatcatcgaaatccagcaggcggatggtaaccgtgtctttgcgccgcatgataacggccgggtagggcaccatatggtccagcaccacctgtttgcccttgtttttgttgccttccagttttctcactagcttgtgcgccttcaagtgggtgtagcgcttgagcatgcttagcgatttgtgtcccgatatggcggagatttccatcatgtccaggctgttcagttcaaacagccgcgatatcgcttcgtggcgcgcgtcgtggaagtgcaggtccttgatatccagcgtctggttcatcagccgccaggtcgatttcaacccggcggcgctgtaggaaaacaccttgcccttgcttttcacgcccagacggatcagcgcgtcgcgcgctttcaggctgaggggcacatctcgcttgctgccgtttttggtttccggcaggtggaccacccgcgtcttcagattgatgtattcccagcgcatgcccagtatctcgccctggcgcatggcggtttgcagcgcgatgacgatgattgaatacagctcggggttggagtgggcgtgcgcgtaacgcaggatcagccgctcttcgcgcggcgtcatcctgcggtcgcggccgggggggatcttgggtttcctgacattggacaccgggttgctgtcgcacagcccccattcgatccgggcgatgtcgaagcagttgctgagcagcgacatttccaggcgcaccgtggcggtggacagtagtttctgcgttttggggttgacctgggtcaggcgttggtcgcggtaggtggcgatatccacgctggtgacttcgcgggtgacgatgtctcccagaaacgatcggcagagctgttctatccggtagcgttcttgcgcgtatccctttttgaggatggaaattcgatcacggtaaatggcgagcgtatctttaagtttttgatctggttccatgtgtctcggttgtcttcgcttggatcagcatggcgagggccgggaatgggatgtccagtgcggagcaaagggcggtcagcgtgtccagggtgggggagcgctggcccagttccatcagggatatatagtttctcgcgagattggcttcaaaacccagggcttcttgtgaatagcctttttgtttcctgaggtcgcgtaaaacgatgccgaaagcgatattgtagatattctggctgttcatcccggcctttcgaattaggacgaaattgtcgaggggggtatggttgacgtcctccaattatagttggaattctagcgggtttcggcggcggatgccccctggggcggggcttgcgatgtggctgatgaggcgcatggggacgagtggccaaggctgtgccagcccggcagcctgggcgccgttgcgcgcgtgtggtggcgccacgtgcgtggcggtcatttcctgattataaaaagtttaatataatgcatatgttgttaaacaaaatatgagagagatggctaagcgtatcctgctgttgatgctactcacctggttgcctgcggcctgggccgaggcgccgccggagcatttcgatgtgaggcgcacggccaactgcgcgctggacgcgtccgaccgctttggcgtgccatacctgcttttgatggcattgaaggtgaaggagtccggcgtgcagttcagcaacccgtatgtgactgggcgcaacagcaatggcagcgtggacatcagctattggcaaatcaatgatttctggctgcccaagctggcgcgctatggcatagaccgcgcgcgattgtatgatccctgcgtcaatgcgcatgtcgcggcctggctgctgtcgacggaggtgcggcggcgcggcagctgggaggcgggcattggcgcttaccatagtccgaatccggcgcgcgccaggccgtatgccttacatgtattgaagatttgggcatccttgcggcaggaatacccggggtggggttgattgcccgggtggcggggcgccgctgcggggatgcgcttgcggttacggcaatgagaaaagcgggccggtgtaaaagaccctgcgcttgccagaaagtggtttcggagcgatgcggtatactgcatggattccgggcttgtgtgtattgcatgaatgtattggggtaaagatgaatcaacaagaatcgcttcttccggttgagcgccatgaggaaagccaggactccgcggagtcccggctgccggtggtgctggcctttccggaggacaggccgatcattgggcgggatctggacgctttcaaggattatttcggcgccacggtggcgcaggcgttggccgcgctgggaatccagacgcatggccggtggtccaccatcgtcaagaaaaacgccgacatgccggtggacggcgccatcgccaacctggtgcgctggtacgccgcgcatccggagcgcttcccgtttggccaggtggacatgcccacgctcaggctgcgcctgtccatcaatcaggattcgttcgcgcagttgttcggccggcgcaaggtggcggtgtctcactgggagcgcaagcaggtgaagcccgagccgcaggtgcagatcatcgcgcgcgagatggatgatctgctcaaatcgtacgagcagcaggcggagcaggagcgcgacggttcgctggtggtgctgcagcggctgttgagcaagctggaggatatcgacgaagacaagaatctgcgcggcaaaagcgagattctggccgcgatccgcgaaaccttgctgatggaggagaagaatatctcggtcaagcaggaagccactacgcgcagcctggacatgctgcacgagttcatggatatcgcggcgttgaattcgtcgttgattccggcgccgccgccgcgccgcaagggcgtgcggcaaaagaaggtgccgatatccggcgaatgatgatgggcgcgtcggcgtggttgccggcgcgcggcgagagcaggctgtttttttgccttgttctggtaaaagtttgatattatataaattatagtaaacatttatctgaaaatatgagagcgcgctttcttgtgccgctgctgctggcgctgcctttggcgccggttcgggcggaaacggtaaccgatcagcaggccgatgcgatcgtgacgcgggcggtggagtctgtcgccggcggcgcggtggcgcgcatccggccgcacagggcgttttccggctttctgcagcgtaacggcgccgccggcctgatgcaggccgcgcgcggccgccgcgacaaggcggtgttggtgctgagcggcgtgatgtacgagtcgggctgctacaagatggcgggcgcgtatttccgccacaactaccagttttcggcgttgggccatgccgagccggccgcggcgcgcgtgggtttcgaccgtctggccggaccggcgtcggcgtggtgcgtggaactgggcagcgatgactggccggcggcgccgcgctgcaaaaagccgtcaccggcggccaagggcaagcaggcgcgctgggacaagctggccgcgcaggcggaacaggcgcgcgcgcgccgcaatgcctacctgtcgtccattcgcttcaaccgctttgattatgtggcggcggtgacgtcgccgacgctggatttgtacgaccccgcgatgcagcggccggacaacgcggcttgcgccattctggcggacgatttgagcaaggcgttgttcagccgcttgcgccatgacgcgggcgatgacgcctactacctgaaacaccgccaggcgatagatgccgcccgcgaggtctggcgcaagatggacgggctggaaaaatgaagacattcctgctgtgctttgccggcgcgctgtcggccattgcctgcggcagcgccgccgtgctgttgtcgtctggccaggcgggcgcggacggcatcagcctgccgcaaggcggtggcggcaatggcggcggccccgccgggttttgtttcgccacgccgtttcagggcgcggtgcgggtgaccagtcccgcttcggccgcgcgcaagcatcccactttgggcactacccggccgcactacggcgacgacatcagcctgccgtccaatacgccgatttatgcgccggccgacggcgtggtggaacgagtggcgttcaatgtcaacaacgcgggcaacttcatcaatttgaagcacccgaacggttatctcacccgttatctgcatctgaattccatttcggtgaaaagcggacagcgggtgcatgctggcgatctgctcggctactcgggcatgagcggcggcaacaacaccgggcccaatctgcactgggaggcgcactacctggtgtacaagaatccgtccccgcccaaggggccgacctccatgctatgcagcggcgcggtgtcgacgtcggaccaaagcgagccgaaacagaccggcgatgaaaacaatacggtggaatggccgaaagacagcgatgcgcccgatccggtgtgggatgcctgcccgatacagccgccgccggtggcaagccagggctggcggctggacgagcctggccgtacgtctaaaccctattaagaaaaggtttgatgtaatgactatcaaacaaaagctgaattcattgccgttgaagagaaaggtgttggtcctgctgctgggcggcggcctggcgctggcgccgacgctggccctggcggacctgtccaacgacatcctgggcaagatcctgaaccaggtgacgcagatcctgcagcagcaataccagcagttcgccgcgatgatccagcaaatggacgtgatgcggcagcagggcgaggcgatgcgcgacaagatggggcaggagtccgacaagaaccgccagcagcaatgcgacatctggtgcggcaagtcgctgcccaagcccggcgaagtgccggccgacgccaacaataccggctcgcccggcgcggcgatgtcggcgcggcgcggcatgaccgcccagctgcaggcggtgaccggcaatatggccggcaatatggaccagaataccgcgatccagggctattacggcgctttggccaattggttccagagcgccacgccgcagcagaagcagcaggtgcagcagccgctgtcgttcgcgcccggcgatgtcccatccgcagaagaccgcaagctggccgattacaacgccaagctcaccatcggcctggagccggtgccgccggtgtcgtccgcccagatcaagagcaatccggccgcgcaggaatacgaggcgcgccgcatcggctacaactccgcccaactggtggcgtatgacagttaccgccagtacgacctgtcggccgaagaggtgaagacggtgtccgacgtattgctgtcgatgtcgcagcaaaccatagaaaacatgaaccccggcacggcgatgaaggcgcaggtgcagctgctggcggtgcagtccggcttgctgctcagccagtaccagtcttcgctgcggcaggagcgcctgctggcggtgatggccgccaacaacgcgcggatgtcgatgagcgaccgcctgcgcaggctgagccagagccaggcggttcagagctatgccaagtaagggcaaggcgcgcgcggcggccatcgtcggaaacaggtgggtgcagggcgtgtcggggaccgcgctggcctgcctgctgggcatgcaggtggcgccggtattgcccggtttcatcgcggtggcccgggcggaggcttccgccgcgtcttacggaccggcggccgggcagtcggccgccgagctggcgcagcgcctgcgggcgctggcgcaaaaccaggtgatggccaactatccggtgctgcgcgaggcctatgtgcagcggcagctcgccaagctgcggcaggatgcccaaaacctgccggataccgaagcgaaccaggcctatcgcgaggcggtgggcgatttctcctggatgcggccgcagctggaagacgcggccagcctcgattactacggcatgccggacgcgttggccaacgagctggtggcgcaggccaatgccgggctggtgcgccaggtgatggccaagtatccgcagcaggtgctggctgtcatggccaaccaggccatctcgctggagatgggcaagatgtttcccgcggcggccgatcaggcggcggaagcggtggtgtgggggtcgaaaaattcgatcgtgcaatatctgggcaatctggataaggaccagttcgtgcagtccatggtcaacagcgtggtggattacgccaagcagcaggccatcgattacttcaagaagtggatcaagaagatcatccaggaaaacatcatcaccaagatcacgtcggaaatcatcaagaactacccgtacatcgggccttatatcagctggtaccaaacgcagaagcagaagctcgacaacatcaagcatcggatcgaccagatcaagaaggaggccgagctttacctgaaaaagctgggcttcgacaacgcgatggagcgccagcaggaagacatgacctggggcaagcagaatctgccggcctatccgaacggcgacggctcgtccgaattcggcacctccggcggcgtgcgctctaatcagcaggtgattgagcggtacgccaggcaggagcgcggcgatttggcgcagtggtcctatgatggcgatcgccccgggacgttttacggctggatgggcagctacccggcggagcggcgggccgcggtgatgcggccgtatgtgatcgggccgcggctggggcaggacggccagctgcagccggtgggcgcggccgagcgggagaatgtgcgccgcaacgcctggctcacgctggggctggagcccaataccccgttcaccgccaagccgggctcgccggcctaccaggaagagctggcggtgcgggcgcagatggcatcggtgatgagcctgagctacggcagctatatggagggctggatggcgcaggaccgcatcacccaactggccagcaccatccagatgttcacgcccagcgtgatcagcggactcagcaccggccaggccaacggctgccgggtgatgctgaagcagctgtccaccgaggtgcagatgcaaacatcgcagtcgcagctgcggtttgagcggctgttcgccgcatcgtcgggaatgttgggaaatatcgaacgcaaggaacaactggccggtttaagccagggagcaccgatcggtgcgattaacgggcgctaggagggggtatgagcgtattgagcgagggagccaaggggattggcttcgtgtttctggaaagggtgctgggcagcgacgccttgtcgtattacggcatccataccaccggggtgaattcggttccgatgaccaccggcatggcgctggccgccgatgtcgcgctatggttcacccccttgatcacgttttacattctgggcatgggcttgatctattcctcccaggaaggcgtggtgctgggcaagcgctggtcggcggtgatcgtgccgctgcgcggcgtcggcggtttgatgttctccgcgccggtggtgccgggcggcttgtccgccatccaggtgatggtggtggggctggccctgctgggcaactacatcggcaacgaggcggccaatgtgctggctgagcggattttcctgcccagcagcggctatgtccacaccaagccagcgtctttgctgaacaacaccgacgcggcggcgacggctttcgccaccatcaccgcggcggcggtgtgcatgaatacggccagcaatctgggcgcggatggcaacccggccaaaaccaacccggcgcctggcggcggctcggcgctcggcatcggcatgcagctgtggggaatcgccaccggaaccggcggcggcggcggcggcggcggcggaaccggcatctccttgtccgacctgtgcggcggcgcgcaaaacgcccaggcgacgaggccggatgcgcagccgagttcgagcagcacgaccgatggatacccgtctggccggatggattgcggatccagctccttcgtcgggccgtgccgcaaggtggaagccgccaattcgacgctgaaggacgcgttgtcggccactctgggcaggatgggcggcgtgctggacgagcgcatcctggccacgctggcggcgacttacctgatgcagatgaacagcgccatcgacatggacatgaccgatgtcatcaaggaaaacaccaaggcggtgcagaagctgggctggcctggcttgggcaacttctatcaaaagtactcgtcggtcagcggcgagatcgacaattacatctattactccggcgagcccagcttcgactttaaagacataggcgatgaaacccgagccggcatggcgctgaacgaccagacgcggatggctttcaagcgcgcgttcaaggcgttcaacttctccgtgcagggcgtgctgtccggcgtaggcggcctgatgcaggccggcaatacggcgatcaacaacgccaacgcctccatcatgggcgaattgcaggtcaacgtggaaaaccggatcttgcgcagcctgctgttcggcgtgggcaacagcgcctacgacgtgggcgcgttcgacgcggtgcagcgcctgggcggtttgctgaacatgttcggcaccaccacgctgaacatgctggtttgcgagaagcgcagcggcagcgacaactcttgcgataagagcaccgccaatgaaagcgcgcagagcgggatggtttccaacgcggtgaaatcgatagccggcggcggcatggccgatgtcgccaccatggtggccaagtccgcggtgatggcgggcacggtgctgaccatgctgctgccctcgttgccgaccatctacttcgtgctgatgacgctggagtgggtgatctggctggtggtggccgcgctggcgtcgccgctgtggatgatcttccacatgctgccggacggcgagtcgctggtgcacagccgcgccgaaaccggctggggcttgctggcctatatcacgctgttcccgctgctggtggtgctgggcttttgcgcgtcgatgacgctgttcaacgtggcggtgccgttcgcctttgaaatgatgatgtcgatcaccggttcgaccgcggtgggcagcggcctggacttcctggtgaaaccgctgctgatggcggccgtggtgataggcgtcacctttctcaccatgggcctgatgatttccctgccgcaccgcatcgccaactggctgaacatcaacccgcagtccgacagcctgcaggaaggcaagagccagctgggcatcagcgccccgaagctgaccgatatgtccggcggcgccgccaatgtgggcgccagcggctggaagggcgcgctgagcaagggcgtgaagcccggcaagtaagcgctaggattgagccggcctggcgcctaggaagaggtcgctggccggcatcgttgcggatggggtggtggcgtgggttggaactgtttcgagaccgtaaggcggattgccgatgatattgccggagattcatgaacatgcatgatcaagcgcatagcgcccccactcgggaaagcctggttgctgccttgcgcaagcgcgagttcagcatgcattaccagccgcagctcagttgccgcaccgccagggtcgccggcgcggaggcgttgatgcgctggcacagcgccgagcgcaatgggccggtcagtcccgccagcttcatccccctggcggagcaaagcggcttcatcgtcgagttgggtgactggagcatggccagcgctttgcggatgatggcggcgtggcgggatgaggcgcgcttgcccgccgattttcgcctggccatcaatctatcccggcggcagatcgtccctgagctgcctggcaaggtggagcggctgattgcccaggctggactggagccgtcttgcgtggagctggagatcacggagtcttatctgttccatgatttgccgacgatggtggaggtgacgcgccagttgagaaagctgggcgttcgggtggcgatagatgacttcggcaccggtttttcggtgctggagcatctgcgccatattcccgccaccaccatcaagatagattgcagctttacccggcagatgctggagatagagcgggaccacatcatcatgcgcaacttgatccgcatggtgcgcgacctgggaatggaaagcgtgtgcgaaggggtggagaccatggcccaactggaggcggtaaaggacatgggggccgactactggcagggattcctgttttcgccggctttgccgggcgcggaatttcggggcttgctggatgccccggggatggacttgcgatgagtcggccggggtttcggcttcagcggggcgtgtggcccaaatgttccaccatgtcctggtcgagggcgtagagcgcttgccggttcgtcggcgccagccgctgctgcggcgcgtcggccagcaaggtggctgctacgacgccttgatgattcaccacgcgcacggcgccgcaggtcggcagcggcaagcccagtatcgattgtcggcgcagttgctgcattctgccaatgcagctggtttccgagcctttgaacactacgcccacatcgtcttctatatgccagatcatttgtttttgttgtgaatttactgtttacacctaacagataatactgatattttaaaccgcatgacatgcgtagatttacttaaattcagctaaaaatgaaatcatcatttgcaaattgtatttataagcaaatgttattccgctgaagatccgcgccggctggcctttcaagccagcgccagataccagcgggtgatttctttcccccagagcagcgcgacgatgccgcctgcgatcagaaaggggccgaacggctgcgtctgctcccgcttcgttctcttggcgactatcagggcgatgccgaccagtgcgctgctgatcgagcctatcgtgatgatcagcggcaacgcttcccatcccagccaggcgcccagcgccgccatcagcttgaaatcgccgatgcccagtccttctttgcccgtgcaaagccgaaaggccgcggcgatcagccacatcgacagatagcccgccatggcgccgattaccgcatcttgcagcggcgccagagactggagcagattggccaataggccaagccatagcagcggttgcgtcaggctgtcgggcagcagcttgctgtccagatctatcagcgccaatgccagcagcagataaagcagagccaagtgggccagggcggccgggctcgggcccagccgccagccgaccgcggcgaagatcaggccgacggacagttccaccagcggatagcgcgggctgatggggctggcgcagaaggcgcagcgcccgcgcagcaacaggtagctgaaaaccggcaccagctgccaggttttgagcgtgtttcggcagccggggcagtgcgaatgcgggtgggacaggctgagcggcgcctgttcaggcggcggcaagccgcaggcttccgcggcctccctctgccaggcttgctccatcatttggggcaggcggaaggccagcacgttcagaaaactgcccagcagcaggcctatggcgaagaggctgccggcggcgcgggccggcgcggagccctgcaggcccagccagctgaaggccgccaatagggcgagggtggttccgcccagcgcgagcgcgctgcgtttgtcgatgcgcatcgcgtttcctcaggggcggaacaggccgggatagggcgcgccatacagcggcaaggcggcgccggtgtcggtgtaggtcatgtttccgttcaggcaggcattgctgaggacgctatccagcgaaaattggtagaacggtttttggctgcggttttccagccgcagctcgccgccgctgcccagcgtttcgcgaacctgctggctggcttgcgccatgcctagcttgcggtcgttgaacagcgccgcgccggactggaacatgatggcgggcagattgtcgaggctggcctggcttttggcgatgcccttttcccagatgtcgtaccagatggcggacatccagatgcgccgcacgccgtcgcacacgtcggcagtgggggtgccgcgtgcctggaataccgctttttcgcctattttccagtaaagcgtcaccggagccttggccgtgccgtccgccaatagggccagtttggcgaagcccaggccggcctgtatccgcccttggcttgcgatgaagttggcgcgccgcgcgcgttgcggctggtcttccagctttttctgcagattgagcttggcgatgtcgactgcgcgcaagctggatttgaccagcaggtcgcgggcttcggcgtagttgcgcggcgcgggcgcgcggtagggaatggtcagcggattggcgctcggtggcgcgggaacgtcgaaaagcggcatctcttctcgcataaagtttgatttagtatgtacttcaatataacatagtttaagaaaacggattaaccaattctctcggtgaggtggcagaatgagtggagcacacgattttggcgatgcggaaagcttggctctggacgaggataggctgagcttcgaggatgagccgccggtggcgcgcaatgccagccggaccatggccgcgccggcgcatcaggatctcaagttcgacgacgagccgatggactcgccgccggccgcgcagcccaagaaagacgccaagcgcatcgccttgctggcgctgatcggcggcgtggtggtcgtgatgctgactaagcccttgtggcagaaagtgctgaatcccccgccggtggaggacccggcgccgactgcaatgcggcctatggatccggtcaagcctatggtgaacaccccgccggcccaattgacgcatcaggccgcgccggcatcgctcggcagcgccagcgtcgcgcagccgccgtccgcggcggcgccgtcgcagcctcaggcgctgctgcagcccggcgccaattcgggccaggccgccgcatcgccatcgccgttgcagcctgacgccgctgcggacgcggcggccgagccggcgctgctggcgccgtcggccaagaaaaccgcgctgagccgcgagccggcggccggcggcgatgccgacgcgtcgcagccgaaggcggcgcaggccaaggaagcggcgcagccggaaagcctagaggccaaggtggcgcggctggagaaagaggtgaagacgctgcgcgagcgcaatcgccagatggcgtcgcgcggcgcggggcaggcgcgcgcgccaaaagcgcacggcgatggcggcaaggacgccggcagcaaggtgctggggatgtcttccacctcggtctgggtgaaaaagtcgaacggcggcaccgctgaattgcgggtgggggatcatttccgcaatggcgaggtgatccagagcatagaccagcaggcgcaggtggtggaaaccgaccgcggccgctacaaggtcagtttctagatcgggcgcgcggcaaggcggacgggccgcgccagctactaaaaggatccaatcatgcgtaaattcttcgcgaagatgctgctgggcagcgacacgctcaacaagctgcattccatccagcaatccgaggcgctggaggaggaagccggcaagaggtttgaagacgcgggccagatgccgcccaaggtcagctcgcccacgatcacccgcgagcagatccgttctctgatcgagatcgacatggaaatccatggcgacatcttcatcgggcgcggggtcaagatttccggccgggtgatgggcaacctgattcccaatggcgcgatcgacgattgcgaccccatcgtcatcgtcagccagggcggcgatgtctgcggcgatctgcacgcccgggtggtggtggtggccggcagcctggatggcgacatccacgccgaccacgtcttgctgatgccgacggcaaaagtgagcggcacggtcaactatcgccataccttgcggcaggacatcggctccgcgctgtctggcatggtgcggcgcgtggaggccatcgcgctgctggatcagccgccgcggccgggcgaggcggcgcgcgccgcgctgcagaacaccgcggcgggaaaggcggacgccatcccggttttgccggtagagcctgacagcgtggtggcgccgctggtgcgcgcggtgccggcggcgcaggatacggcggaaatcgaaagcctgtaccgcggcctggacgtcgcgcgtgaaaacccggcgggcgggcgcgtggttgcgctcggggcttgatccggcatgcgaggttttttttgaccctgtattttaatagttatatttaagtagtaattttaatataatttttcatatgactatgcaaagtgttgagctgactggattccgcgccgagagccatgctccgcgcctgccgccggatgcgccgcgggagccggacctgcgggaaatggggctggctcgcgagctgccgccggaggcgctggacgacgaagaggacgcgcgctgggcgtatctgccctttttacagctggccatcgagcgcatgtgcgtgatggcgctgttggcggaggaccacgacgtggcgttcgcgccgctggatgatgccgctttgccgcgtatgcggcaggattgcggcgccgatccggtgttcgcccgcgcggtggcggactatctggcggcgttggctacgctggggtcgatgagcggacgcggcgaagacgaactgcatcggtccatcgccggcctgtatcaagggagagcgcaatgatggataggcatccgcatggccgccgggcttatgcgcaagaagccgcgcagcggattcacgaacaagtggccgcgctgggcgcggagcatgtcttcgcggctccgttggccggcgcgcgccatttcaacccgctgactggaacggtttaccaaggcatcaaccacctgttgctccagtcggcgctgccggccgcgtctagcgatccgcgctggctgagctacaagcagatacagtcgctgggactggggctggcgccgggcgcgcgcgccggtctgctgcttttcgcccggccgatgcaggcgttgacagggccggcgggaccggcgctcaaaggatgctcggtgttcaacggcgcgcagattctcggtttgccgccattgtcggcgcacccggccgccgcgcatgccggcggcggcaaactgcagcaactggtgggcgccatcctgggcgagctggggctgcgcgaggaaagcggcggcgcggccgcgatctacgacccggtgggcgagatcatccgcgtgccgcaagccggctacttccgcaatatgcgggagtacaacgcggcccggctgcgcaaggcggcgcagtgggcggcgcaacacgagaagcggccgagggcggcgaagcgccggccgcggcatcacggtccggacgatccgctggaagagctgtgggcgcatatcgtctccgccctcctgatgggcatgataggtttcggcgccgcgatgccggccgaggggcggcaactgggcggagcgataccgctgttgcagcgcatgggcgaaatcgacttcatggaatggttccatggcgcgcaccaggtggagcaggtgctgggctggctcggccagctatcgcctaccttggcgcggctgatggaaatcgagcggcagttcgtgcgcggcaatctgctggagggcggcgacacgtccgccccgcaagcgcagccgtccgccgcgacgccggaggcgcagatcgcgggcggccaactggcggatgccggggaaaccgagcgggaaatggcgcgcgaagcccgccgtcatgccttgctgatggatgtcgcgctgctgacggcgccggagctggcgcatcagctggccagccacttcggcgcgcagcaggtgctggccgaaaccgacgccgccatccatgaaaaattccagcattgggcgcaaggcgcggtgatgggaggaatgttcgacggcgcggcggccaaggcgcgcgagctgttcggcatgttcctgcgcgagcgcggcgaggaggtgggccatctgctggaaaaagacggagagtcgcagcggcaggcgaggatggccgcggcgattgagatgccgtccgccggctcggcggggaagatagccgtgatcggcggcgccgaacccgcggcgccggcgcgcgagatttccatccagcctttccgcgacggcaagggcggctggctgaaagtggggcaccaggatgtgatcgaactggggctggtgcgccagatcgccgacgacgattcgcggatgacgcccagcgccgtttacctggcttttcgcgaggatgctccgcattgcgacgcccagcggctgatggacgcggtggacgcggcgggctggaagatccagtttcagcagtatgtcgaatccaaggattcgcagatccgcagctacgccagctatttcgcgcccttggtcggctatatgcccaagatcggcgacaaactcaagttggttgaaggcgtggccagcatcagcagcaagtccggcagcggcggctgggtggtcagctttgacgacgccggcaagcaaagggcgttgagcagcggccgtttctacgacttcatcgagtcggtgatcgagggagatttcctttccccgcccgcggcgggtaagcccgagcgcgcggccgcgccgcagcccaaggccggcaggccggcgctggacgacgccgcgctcggcttttagcgcggtggtttacgcaatgctttgttcaatctgacggtggttgccatggaagaggaactcaagaaactggagagcgacctgatcgcgatgatggatgaccgcttcatggccgtggaggattccctggccaggctggtcaatctgggcgagcagcatcagcgcaaactggtctccaatgacatgacggtgcggcgtttcctgccgcagttcggcatgtgcgtggtgatttgttccgcgctgatcgtcgttccggtcgcggccgcggcgtggtatttgcaggaaggcaaggtccagcagctgcaggcccagacgcgcgaataccagcgccaggcagtcaggtcggcggcattcgaccagctttaccaggcggcggactccggcctcaggctgcgcatgcagaatgcggtggagcaggccgccgaacaggccggcacggccggtcggcaataagaaaacaggatcaagtctggcaatgcgaatcatatatccggaagcggtgcgttgatggcggccccgatgcgtcggagtcaggttgaacgcgacgtcgttcccttttcccacaaggtgctgggttggctgcgccgccaagagccggcgtttctgaccggcctgggcgtggtctacctgctgtgcccgattttcccgctgttcacgctggctttcgccggcgcagcgatgctgatgtcgcgcaaccgggtgatagaccacccgaaggggccgttctggaaaccggtgcccggcggcgacaaaaagctggcctggacccggatggaagggccgccggacaagggcggcaaaggcgtctggtgcatgggcaacgccatggataccaaggaagagatttgggtcagcgacgacaccatgcgcgtgcacgccaccctgttcggcaccaccggcggcggcaagaccgtggcgctggaggggctgatctgccaggcgatcggccatggctcgggcgtgatcatggtggacggcaagtccgatccgaaaacctggttcgacatcgtcaccatggccaagatgtatggccgcgaggacgacctcttggtgctcaacttcatctcctccaccggtttcgagaagctggcgatcctggacgatgacgacgccggcggcgccaaggacaagatggacttgctggggcagatccactccaataccttcaaccccttcacctatggttcggccgacacgctgaccgagctggtgaccggcctgatgcggccggatggcggcggcgacggcgcgatgtggcgcggccgggccgaggcgatgatacgggcgctgatgcgcggcctggtggccatgcgcgacgccggcaagatcacgctgtcggtgcaggcgctgcgcgactacatgcggctggacaagctgggagagctggaaagcgacgagagcatccccggttacgcccgcgaacagctcaccggctatctggatgagctgccgggctttcgcgaggcgatcaacgccaaaaacaacgatcccgccgccttcgacacctactgggagcaggccagcaagcagcacggcttcctcaccatgcagttcaccgaactcttgggcctgctgtccggcacctatggccatatctgcaatgtggagtggggcgatgtcgatttccaggacgtggtctacaaccgccgcatcttgtacgtgatgctgccggcgctggaaaaggcgccgtcgtcgctggccaacctgggccggttgacggtggcgggcatcaagaacgcgctgtcggtgtcgctgaaggcccagctcaccggcagcaagcaggagatcgtcgactcgcgtcccaccaactccgacaccgcgctcctggccatcatggacgaatacggctcttacgcggtggaggggttcggcgacgtggcggcgcaggcgcgttcgctgggcgtcagcgtgatcttcgccggccaggattatccatcgttcaaaaagggttcggagatcgaggcctcgcgcatcctggccaacaccggcatgaagatcttcctgaaaaccgaagaccaggaaaccgccgacatcgccatcaagcgcgcgggccagggcgtgtatgcctgggccggaggcaagcgcaagctggaaaattccgaccggctggtggataccggcgacgccagctaccgcgaggaaaaccggctgacctatctggatctggtggacatggcggaaggccaggcctggttcatgaaccgcaatcatctgatcaagatgaataccttctatgtgcaactggacggcgcggtggcgaaggacgccaagcacaacacgctgttcccgctgggcaacgacatgtcaaaggcgctggccgccgacaagatcatgcaggatgtgatgggcgtgtccgagcctggcaagggcggcgagtcgatgctgcgcttcaagcggcgcatctttgatgatgtcgagcagctgttccgcctggccgagcagcgcgagatccctgccgacccggggtccggctggagcgcggcggagcaggcggccggcgctctggaagaggatgttttcgtgcgcatcagcgatctgcaagccgaacatggcttgttgatgcgggcggcagtggtggccgaattggccggcggcatgctggcggatgtgccgatggtggagcggatggccgagcgcgaggaggcggcgctgggcgccagaatgtcgccggatcagctggccggctatgccgacagcctgctggagcaggccgagctggagggcggagcggcgagcgatgcggaacgggagcggatgccggccgaggccaaagccggcgtagcggcgccggatgcggtcgcggaggaggaacatgcgccgttgccgctgaccggcttctccgccgcggcctttttccatgccaccgaaaccgaggccgagccggaggaagcgccgggcggcaatttcgacctggcggatctggcgggtttcttcggcgccggcggcgaagccgagccgcagagccatcaggaagaggaaggcggggtcgatccttatctgagcgaggtgctgctggagtgcgaggcgctggccgaggagcacggcttgctcaaacaggccatgcgcattgatgccgcgctggcgactctgctggggcgcggcggcgacgcggagcgggaactggacgagatggaccagcaggccggctatattctgggcagcgaggacgccgggcagttcctggagctgctgctggccgaggcggaagaagagcgcgctcaggtttagcgcgtctcgcgcgacaaaaacggcggcgtccgcgcaggtggatgccgccgtttcgttttgccgtttggcgatattcaggctgactgatctgcagccagctcggtgacccaatctccccgggtcaacattgacctcccctcggaaaaaccagcggcgaaaagcgggccaactttctgatcagcacttaccgcgtcagcattcgatgcgccaccgcggcaattcaactgcggcaaggcgcctattgttatcggcccaccctcgagttgtttacctggcggagattcagcccacgcttgcgcctaagacgtcggacactacgtcttgactgccaatctccggcaagtccccctggctcaagtcatgctctcgcggacgggagggcgtcccgcacgcaatgcatggagtggttctttcgtctcagattctcgatactccgctggcgctgcctgacaagagcgcgggcgcaaagcctctctgagcgggaggcgattgagtggccgcggtttcttttggggttgatcgctagtggagaagcttcatcagcagcgtggccagaacgatcatggccgccccgccgatgcgggtcgagatttgcgcgaagggcatcatttccatccggttggcggccgacaggatcgccacgtcgccggtgccgcccaggccgctatggcaggcggcgacaatggccgactccaccggatacatcttcagcaacaagccgatgccgaagccgctggccaccatggccagcacgatcaccgcgcagagcagaacatacccgggggtgacggaagccgccatctggttccatggcacgaagagggtgcccagcccaaccaggatggcgaatgtcagattgctggtcatgaacttgtacatctggtaggaccccagctccacctgcgccggcatcaccctgctcaccttgaccagggcggctgtgataatcatcaggatcggccccgggatgccggtaatcggggcaaataaagaccccagggtgaaaaaagaacaggtgagcagcaagccgcttcccatcaagctcaagttgatcggcgcttcatgctgcgcggccagcaattcccgatcttccccggttttgaccaacatgccattgccgctgaatcgcgggcgcttcttgccgtagaagtggagcaggccggccagcaggatggcgacgacattgccgatcagggccgcgggaatcagtgtggcgacaatctgagcctgcgggattcgggtcatttcggaatagccgatggagagcggcagaatgccctcgccgatgccgccgcccaaaatgggaatgatgatgtagaagaaggtgtgccaaggggtgtaaccgaataataggccgacaagcatgccggcggcgacggcgcccagcgttcccaccagcagcgggatgaacatccgcaaaaagccctgcaccaaaaccttgtggctcatgccgagaatgctgccgaccaccagacaggcaatgtagaggtattgcagattggctgtcttcatcgccgtggtcagcgctttcagcatgtcggggtcaaacagcttgtatcccagcaatgccgaggggacaaacaggcagagaatggccgagccgccgatatgcttgagcacgggaagcctcttgcctagctcgcccagcagaaagccggacaacatcatgaccgccaggccgccgatcaggtcgttcggcaggcgatgcgcgatggccgcggcgaccacaatggcggcgagagatagatagagcggcaagggcagcggtccgatgcgcatggccatcagcgtgctccaaggcccattgcctgccggttggttgctaacggtttcctctatatgcatttttgtctcctcagatagggcgtgacggcgccgccggaccggtggcccggcagggcgctccgcttacgccaaacggttttttgtcgtggaggcgatgtctttcagccagggccgttgctgccaatgcttggcggcgaaagcatggatctggtcttgcatggccaaggtcgcgcctatcatgtccaggccttcgaggaacatccggcgatggcgctcggacagcgagaaagacgccgtcaggctcctgcttcgcaccgtcatcgatgcgacatcgatcgcgaccaggctgttttccggcgcggagacgtcggccagaatggcctcgacatcggcttcggccagcgccaccagcatcaggctgttgttcatcgcgttcgaatagaaaatctcgccgaagctgggagcgatcaccgcctggatgccgtattgccgcaggccccagaccgcgtgttcgcgactggagccgcagccgaaattggggccggcgaccaaaatcctggccgccgcgtattccggccggttgagaacgaatgcgggccggggtttcccatccgggccgaagcgcatgtcgtatagcaggccttcggccaggcccgccttgtcgatgcggcgcaggaattgcttaggcatgatctggtcggtgtccagattgctgaccggcaacggcgcggccaggtcttcgattcgggtgtgaacggtcatgcttggactcccagtttgcgaacgtcggtgatgcagccggcgacggcggcggcggcggccatggccggactcatcaggtgggtgatcgcatcccggccttggcggccttcgaaattgcggttggtggtggaggcgcagcgctcgccgggattgagcacgtcgtcattcatggccaggcatagggagcagccgggttggcgccattcgaagccggcttcgatgaacagctgcgccagcccttcctgttcggcctggcggcgcacttcgcctgagcccggcacgatcatggcgcgcaccgtaggcgccacgctgcgtccgcgcacgatgtccgcgacggcgcgcaagtcctcgatgcgggcattggtgcaagagccgatgaagacgcgctgaacgggcaagccttccagttgggcgccttcggtcaggccggtgtagcgcagcgcccgctgcatggtgagccggtcggcgccttccggcgccgacgcggcgacggggatgcggccgctgatcggaatggattggtcggggctggtgccccaggtcacatagggctcgacgtcgccggcctggaattcaagctcaaggtcgaatggggcgccgtcgtcgctgcgcagggcgcgccagtccaccttcgcggcgtccagcgtcgcgccggccaggtccgggcaatggtgggcgatgtattccagcgtcagcgcatccggcgcgatgagcgcgccgcgcgcgccggcctcgaccgccatattgcacagcgtcatccgcgcttccaccgtcagcgactcaatggcctcgccgcagaactcgaccacatagccgcgcgcgccgtgcgcgccgatccggttgatgatcagcaggataagatccttggcggtggtgccgagcggcaagcggccggcgacatggatgcgcatggtttgcgcgaggcgatacaccagggtctgggtcgccaatacgtgttcgacttctgaggtgccgattccgaagcccaaggcccccagcgcgccataggtcgtggtgtggctgtctccgcagagaacgaccatgccgggacgaatcatgcccagctccggcgcgatgacatgttctatgccttgaaagcggtcgttggcatcgaacagcgggatgccgtggcggtcgcagttcttcttcaggttcgaggcctgcaatgccgaattcggctcctcgatgatgcggatcgccacggggtgggtcgggatgatgtggtcgaccaccgccacgttctggccgggttgcgagactgtgcggccggcttccgccagcccggcgaaggcttgcgggctggtgtactcgttcatgatgtgcaggtcggcgtaaagcagcacgttctgggtatccagacgcgccaccgtgtgggtttcgaccagcttctggtaaagcgtttggggtggggtttgcaatgcggtcactcttgtctcccggtgagcctgaaagcgaggcggcttcctttggaggcaagttagtggattgcaaatttctgtacaataattgaaatataaaactgtttttaacttaaatgcaaaaatgaactccatatccgacgtcgcttttttcctggaagtggtgaaggcgggcacgctgtccggcgcggcgcaagaactgggcgtatccaccgccgccgtcagccgtcgcttggccaatttggaggcgcggctcggcattcggctgttgaaccgcacgacgaggcgagcggccgtcacgcatgaaggcgagctgtatctggcggaggggaaaaagattcttggggagctggaggagttggagcaaaggctggccagcgcccaggccatcccaaaggggctgctgcgcgtcaatgcgaccttcggcttcggccgccagttcatcgccccggcgatagcggactttgtcgagctttatcccgatgtcgacgttcagttatcgttgtccgaccgcccggtcaatctgatcgaagagggattcgatgtctgcatccgcttcggcgagttgcccgacgctcgcatcacttccaggaaaatcgccagcaatcgccgcctgttatgcgcatcgccggcctatctggagcgtttcggcgcgccggtctccccgatggatctgcagcgccaccgctgcattgtgatccgggagagcgacgaaacctatggcgcgtggcaccttcactcaggcaatacgcaagccaatgtgaaggtccgcgggaccgtctcgaccaacgatggcgaggcagcggtcagctgggcattgcgggggctggggatattgctgcgctcggagtggaacgtcgcgccttatctgcgttcgggacgattgcgcgaagtgctcggcgactggcggtttccggcggccgacattcacgcggtctatccgatgaagaacaacctgtcggcgaaagtgcgggccttcgtcagccatctggataagcactttgagccatatcggcccaggggggatggcaagagcggctggtagcatccgcaagcggcaatgtcttggcgacccggctcttgagtatgatgtcggaaagatcgggatggatgataaaaagccgccaactttttcgcgttggcggctttgcggtctaattagatgccggcggttacgatatcttcgcgcgtcagcaggaacacgaagccatcgccgctttgcgtctccatccacatgaaggggagggtggggaagcattcttccagcatgtcgcggttgtggccgatttccaccatcagcacgccgcgctcgttgaggaattccggcgcgcggcgcaggatttcgcgggtggcgtccaggccgtcttcgccggagcccagcgcgatttccggttcgtgcaggtattcttccggcagcgcgtcaaccgactcggcatcgacgtagggcgggttggaaatgatcaggtcgtatttttcttctatgccctcgaacatatcggtgtgaaccaggttgatccggtcctgcaggccgtaatgctcgacattgatcgacgccacttccagcgcgtccagagaaatgtccaccgcgtcgatttcggcgtcggggtagtggtgggccagctggatggccaggcagccggagccggtgcacaggtccagcgcgcgatgcaccagttccgggtgttcgatccacggctccagcggctcgcccagcaattcgtagatgaaggagcgcggcaccagcacccgctcatccacgtagaagctgaattcgccttgccaggcctcattggtgaggtaggccaccggcacatgctcttcggcgcggcggcggatcagctccagcacgtcttccagttcggacggcagcagcttggcgtccagataggggtcgagctggtctatcggcagctgcagcgcggtcaggatcaggtaggccgcttcgtcgtgggcgttgtgggtgccgtggccgtaggtgagctcggcttcgttgaagcgcgtgacggcgaagcgcagcaggtcgcgcacggtgctgaaatggctggcagcctgttggtacatgggtttcctttcaatgcaagggggacatggtcggcccatgtcccctggtagtctggcgctgccgcctggcggcggccagctttagaacggcagcttggcgctggtggcggtgcccagcacgcggcggaagtcgcccttgattctttccagcgcttcttcggtatcggcttcgaagcgcagcacgatcaccggcgtggtgttggaggcgcgggccaggccgaagccgtccttgtattcgacgcgcaggccgtccagcgtgttgacttcctcggcgccgtcgaagctggcggattcctgcagtttggcgatcagcgcgtggttctcgccttccttggccattttcaggttcagctccggcgtggataccgcgttgggcagcgcgttcagcagctcgctcgggtcttccacgcgcgatagcacttccagcaggcgggcgccggtgtagatgccgtcgtcgaagccgtaccagcgctccttgaagaacacgtggccgctcatctcgccggccagcagcgcgccggtttccttgatcttggccttgatgaagctgtggccggtgcgcgccatcaccggcacgccgccgttttgcttgatccagggcttgagcaggcgggtggacttcacgtcgaagatcaccttggccttgggattgcgttccagcacgtcggcggcgtacagcatcagctggcggtccggccagatgatgttgccgtctttggtgaccacgcccaggcggtcgccgtcgccgtcgaaggccaggccgatttcggcgtcggttttctgcagcgcctcgatcacgtccttcaggttttccggcttggccggatcggggtggtggttggggaaggtgccgtccacgtcgcagaatagttcgcgcactttgcagcccaggcggcggtacagcagcgggccgaaggcgccggccacgccgttgccgctgtccaccacgatgttcagcgggcgctccagcttgatgtcggaggtgatgcgctcgaaataggcttcggcgatgtcttcggtgcggtagccgccttcgcccgcggcgagatcgccgtcgacgatgcgttggtacagtttctgaatgtcctgcccggccagggtgtcgccggccagcatcatcttgaagccgttgtagtcgggcgggttgtggctgccggtgaccatcacgccggacagcgtgcccagttggtgggcggcgaagtacagcatcggcgtggcgacgcggccgacgtcgatcacgtccacgccggcggcgcggatgccttcggacagcgcttcgcacagttccgggccggacagtcgaccgtcacgacccaccacgatggcccgcactttgcgggcaagcgcttccgaacccacggcctggccaatctggcgcgcgacggcggcggtcagcgtcttgccgacgatgccgcgaatgtcataagccttgaagatgtctttggatagtttgttcatgatggttttgttgcggtcgattgtgtttgaagggcggcgccgctatcgcaggccgccttgtccgtatttcagttgccgaattgccggctgagcgccaccagctgatccagcttctggcgcgccttgccgctgtccaacgcttcgcgcgccatggtaacaccgtcggccaggcttggggcgatatcggcggtatagatggccgcgccggcattgaacaacacgatgtcgcgcgccgggccgggctcgccgtccaacaccgacagcagccgcagccgcgattgttccgcggtgtccgcgcgcaggtctttcagttcgcagcgcatcaggccgaattcgccgggctcgacctggtattccagtatctcgccgtttttcagctcggccaccatgctggggccggacagtgtcaattcgtccaggccgtcgcaaccatgcacgatcatcacgtgcttgctgcccagctgcttgagcacgcgggactggatgcccaccaggtcggggtggaagacccccatcagttgcttgtcggcatcggccgggttggtcagcggccccaggatgttgaagatggtgcgcgcgcccagttccttgcgtatcggcgcgacatgcttcatcgcgctgtggtggttgggggcgaacatgaagcccaggccgatttcgtcgatgcagcggccggcctgttccggactgagggccagattgacgcccagctgttccagcacgtcggcgctgccggaactggacgataccgagcggccgccatgtttggcgacgcgtgcgccggcagcggcggcgacgaaggccgcggtggtggagatgttgaacgtgtgcgacttgtcgccgccggtgccgcaggtgtccaccaggttggcgcggtcggccaccggcacgtgggtggcgaattcgcgcatcacggtggcggcggcggcgatttccgaaaccgattccaccttgacccgcaggccgatcaggatcgcggcggtctgggccgggctcaattcgccgcgcatgatctggcgcatcaggtccagcatttcgtcgtaaaacagttcattgccgtcgatcagacggttcagggccacttgcgggctgatcatgatgatggattcctatgagccttggcggccaagctcggccagcctttgcgtgtccaggtcgatctggcaggccaggcgggcgcggtcggcgccgttgccgctggcgtagctggcggccagccagtcgcattgctggcggcggtaggtttggtacgcttgccgggcgcgcagcagggcgcgggcggcgtggaagcggttgtcgctggcgcggtccagcttgcgcatcgccgccaggcttttgtcctcctgcgcggcgagcaggcgttgcgcgtcggcgtggcgctgctgcaggcaggccgcgacggccggcgtatcggcggcgctttgcgcgcagtcgtccagcgcgcccgcccacgcgggggaggcgagcagggctaaggccagcgtcagccgcatgcgcatcaggcgaattccttcaggaaattgtccagcatctggtggccgtgttcggtgaggatggattccggatggaactgcacgccctcgatcggcagcgtcttgtggcgcacgcccatgatctcgccgtcgtcggtccaggcggtgacttccaggcaatcgggcagcgattcgcgctctatcaccagcgaatggtagcgggtgcaggtgaccggattgggcaggccgcggaacatgcccttgtccagatggctgactggcgacaccttgccgtgcatcagctgcttggcgtgaatcaccttgccgccgaaggcctggcctatgccctggtggcccaggcacacgcccatgatgggcagcttgccggcgaagtgcaggatggccggcaccgacacgccggcctcgttgggggtgcaggggccgggggagatcaccaggtatttgggctgcagttcttctatctgctgcagcgagatttcatcgttgcggaacaccctcacgtcctggcccagttcgccgaaatactgcaccaggttgtaagtgaaggagtcgtagttgtctatcatcaacagcatcggggttaaatccttgattgcgctggattttgttgccattccagctgttcagtgccccggcggcgctctgtcgagcgcggggcggatatgagatccactataccggatagcggcggcatgcgcagcctaccggcgcggggggcgtccggcctctgggggaaggaagccgcaagcggcgaggccctgcttcgggtttgacatggatgcgcttatgcgtcatatcgcagattgaatggtgtcggatagtcaggaagcgacgatggaaagaacgttcaccgtgctggtggcggaagacgtggaggccacccgccggttgatggggctggtgatcgaggaaatggggcatgcggtgcggtatgccgaaaacggccggcaggcggtggagcagtgccggcggcaattgcccgacatgatattgatggactgcatgatgccggtgatggatgggcaagaagcgatccgtgagatccgccggctttgcggcgaccgctggctgcccatcatcttcctcagcgcccgcagcgatgaagaggcgcacatcagcagcctggacgtgggcgccgacgactatctggtcaagccgatcaacctcaccatgctggccgccaagatccgggtgatgcagcgcatctgcgagatgcaaagccggatttcggccgactcgcaaaaactgctcaactattacaatagcaacgagcgggagcagcgtttcgccaagcacgtgctggacagcatcgtcggcagcgaggagcaggacctgcccggcgtgtgcggctggcaattgtcggccgagcaattcagcggcgacgtgctggcgcgggcgctgtcgccgaccgggcagctgtgcatcatgctggccgacagcaccggccatggcctgtcggcggcgctggcctgcttgccggcggtggacattttctacgcgatggtccggcgcggttttccccttaccgcgatggcgcgcgagatcaacgccaagctgaaccggctgctgccggtggggcgcttcgtcgccgccgccctggtcgccatcgactgggagcaagcccgcatcgaggtgtggaacggcggcatgccctgcgtggtgttcgccgccgatgacggcgcgctgctcaaggagtggaaatcgcagtttccgccgctgggcattttcggcgtggaagacttccgctgggaaagcgaaacctatttctgggagcagagcgggcagctggtgctgtgctccgacggtttgaccgaggcggaagacgcgcaaggccggcaattcggcagccgcggcgtgttgcaagcgctggcgcgggctggagaggacgcgccgctggacgcgatacggctggcggtgctggcgcacttgggcggggtcaagaaccgcgacgacatctccttgggtgtggtgcggctggaggccgacgcgagcatggcggcggagcggggcgccgagccgctggagcgcgacgacggcggcctgctgtccaactggcagatccagctggaattcaacgcggaggaattgcgccgcgatcaggcccttcccatgctgataggctggctgaaccaattgggcctgcgcggcgggcagttcaagcaggtgctgctggtggtcaccgagttgttcaacaatgcgctggaccatggcgtgctgcggctggattcgcaaatcaaggcgaaaccggacggctatgagcgctacttcgtgctgcggcgcgagcgtttgaacggcttgcgcgaaggctgggtggccttgcggatcgagcgccgccgccatgaggggcgggacgggatattcatccgcctgtgcgacagcggcgcgggtttcgatcatgtctcgctgctggagggcttgcgaagggagccgtccgaactgccgagcggccgcggcctgcccttggtgcgggccctgtgccgccagctggttttccatggctgcggcagcgaggtggtggctgaatttcccctttgattccggctgtggcggggttcagcgcggagcggtcgcggcggcgcccggcagcgccctgccgctggcggtggcgttgcgcctcactttggcctgcagctgcatcaggccgtaaagcagcgcctcggcggtaggcgggcagccaggcacgtagacatccaccggcacgatgcggtcgcagccgcgcaccaccgagtagctgtagtgataatagccgccgccgttggcgcaagaacccatcgatagcacgtagcgcggctccgccatctggtcgtagaccttgcgcatggccggcgccatcttgttggtcagcgtgccggcgatgatcatcaggtcggcctggcgcggcgtggcgcgcggaatcagcccaaagcggtccatgtcgtagcgcgccgccgccgcgtgcatcatttccaccgcgcaacaggcgaggccgaaggacaaataccacaagctgttgctctggctggcgccgaacaggctatccagcgtggtcagcatgtaaccgtttttttccaggcttggggtcatggcatggcttccgagtcgacgatggcgccactgtagccatggcgggcgccgccggcttgtaccgaaacgacatcgggcggcagcagaatgtcgcggttgccttcgcccagcaccagcggcagctcgtggtcctgatactggatcaggctcatttccaggttgcggtcgccatggctgcggcgcaggaaatcccccggcgtcaggccggacagcgcgcgaaagtcgcgcgccatgtgcggctgatcgaaatagccgcagtccgccgccaatccggccagctggccggcggcgtccgggcgcgagatcagcagccccatcatgctgacgaaacgcatttggcggcgggtgtcgcgcaatgactggccatagctagccaggaagcggcgctcaaattggcgcaggcccaggccgcagcgctcggccagggcgcggctgtcggcgaacagccagtccggcggcagcagcaaggggccgccgtctttggcctcctcgcggcgcgcggcctgccgccgcagccaatcttccagaatgcgcgccatctgccagggctggcgcgcggcttgcagggcgtcatgcagcgcatccgccgccgggcggcccgccagttcctcaagcggccagctttgatcggcgatgcgctggcaatcgagcgggaacagcctgcttagctgcccggtgcgcagcaaggcgctgatgaagcgcgtgccgggcgacaggcgtatcgctatcggctggctgaacggtccgctgacgaagcatcggggcgtgcagcccagcgggcggccgttgatttccgcctggctttgaccagccagcagcacgccgatcagagggaagggcgtggcggggatgcgcacgaggccgctgccctccagctggagatggaagtagcggatcagcggcgccaggcgcggggaaggcgggagcagtaatctcgacatgcggtgaatgatattcgcatgccggccgccccgcccgcatttttactgcggcatcgcgattcttcatgcttgtgccatattgaatgggcgaggccatcgccgccgaagcgaggtttccaggcattcgacgaggagcgtttatgagcgggcacggatattgggccgcggcgatcgcgctggcggcgatattgagcgtacaggctgcgtcggcagcggatgccgccgcggggcagtgccggacgttgacggatatcgagggccgctatcgttgcgccggcgagtgtgtgacgacggcggcggacggcagccgctccctggtgaaggtgtcgggcgaggaggatgcgatccgccggtttgacggctcccaatggatatatcagatcgacatcaccggctccggcggtttcgccgaaacggagatcggcgggctgagcggccatgtgctgcagacggcgacggcccatgtctcggatcagcaatatccagtgctggaggagtatgccttcgcggcggacgaccattgccgggcgaccggctacgtcaagaccgtgcgcaatccggacccggtggcgctgaaagcatgctcgctggcgtgttcgcgctagcggcatggccaaggcccggcggctagccgagccttgggcgcggggcttacgccgcgtggccggcgcaggcgtgcagcaggctttggtccagcacgtcccacatctcggccaacggatcgaggaagtctagcatgccttccaggatcagcggcgcggtggaggcggtcagcgtggcggccacggcctcgcggacgtggttctcatgctggctctccgcgccgcattcgccccagtggtccagcagataatgcatttccgggtcttccagcctgacgccgtaatggccggtgtccaccagcgcctgtttttcccctggaatcaacgcgcggttggagatgatttccagcgcgaaggcggtgcccaggttgcgcatcgtggaatcgaagtcgctgcgggcccggcgctggaaggccgccatggcccgccgggtttgcagcagcaggccggttgggcgctcatagccgggatggtcggccagcagccggtccgatgcctccttgagctcggtttccacttgctgctggtcattgacgtcggcgaagcgcgggcgcgcgccgctgcggttgacgatatggccggccattctggcgaggtcggcgccgtggccttgttcggactgcgcgatttccgccattaactgcgcctggctgatcaagcccagcatttccagcgcgccgggaaaggcttgcccggggcgggtggcggcgcagaaggcctggatctggtggaatagagcggcgcaggcttccgcatccggcgcggcatgcgcccaatgctggaagatggggtgggtgtaagcgcggtggctctggactatccggcttagctgttcaatcgtggtggtgctcatgggatcctctcttttcggtcgaaaccccctttgtgcatgatctagaaatattttctgccggcgctggcgtcggggacgcgatatcccagccggacgatgtgttgatcgatgtcgcgttggtagacctcccgcagctcatggttggtgcacgttctcaggccccatttcaccgccagccggctgcgccgcgagtcggatttgccgaacatgtccagcgccatcgggtacatcttgtccagcgcctgctgggcgcggtggcgggagtcggcctgttcgcgggcccggcgcatcagcaaggcgccgtgggcgaagtgcatggcctcctccttgagaatctcccgggcctcgatggccagcggccggtatggactgtccaccatctccttgatctggtaatggccctccagctcgcaaagaaagctgaaagccgcgcgttcttcccaggtgttgaagtcggtagtcatgctttcggcggcgaaaaagcggcgctctttcttgtcttgtcggagcatgtgggaggtgtctatccccatttcggccagcagccgggcaaagcggcggaaatgatccacttcttcggcggcgaatttgacgcaaatgtatctttcgtcggcgttaggcgccaaaggatagaaggagtcgacataggtatcgccggcgctgagctcgccctcgccattggccagcatctgatgaatcaggatttcccgaaattcgtcgggcatgtccgcgtgctcgatggtgccgggcggatggtggtatgtatggtgttccatttgcttgcctcttgaatatttggcgtaacgacgcgttggtttccccttgcatggatccggaatgacaaatgcccagccttcccgcgcggcggcgggagcggggcggtgcccgtgattttcaggcgttgatataggtcagcgtgtgatgggaaacgatcttcccttcgctatccgttatggtggcggtgccgtacaggatgcggcgtcccgcggtcatgacttccgcctcgcagcttaggtcggtgcgggctgctctgaggaaattggttttcatctccagcgtcacggcgggcgtgtctaccccggccaccgtcatcagcgccagccagaaggccacatcggccagcgtcatcatgctgccaccttgcgccacgccgccgggacgatagtgctcgggtttcaatggcaggcgcaaaatcgccttgccgggcgagacggcctcgacctggaaattccaccaggggccgaaaggcgattcggcgaggatttttttggcttgcgcgacatccagcagcaacggagcgtcttgtttcatcggggaattcttgccttcggcgcgcgggccggcgatttggtttatgttcaaacaatctaggcgcggctgcggcttggcggcaatcgtagaactacggcaataagcaaaaactgtactttaggattgctttcgcgtggtgtgattgtcgaatcggggcgggtttggctggcagggcggcggcgcctgtcgcttcgccgtggccggcagggcaaactgttcgaaggccgagctagattgggacagcttgggggcgaatttgcgacaagccatagcgcattacagggggcttgtgaaggcttggtttggagcgcttattgaaggaggccttgatttacgggctttaaggcgaaacgcaggggtgaagaaaaaccagggatggtgcgaaaggagagactcgaactctcacgccttgcggcgctggaacctaaatccagtgcgtctaccaattccgccactctcgcatttcgagacttgaaaacgagtgatctgccacccacattcaatctcgaagaggacggaatgttaacccaacagccagattaagacaagtgtttggccgacgacggaaacttattccctccgacagggtctcttgcttacaattccaagcgtttcacagaacaactcactcaggagagcttcacatgcacccggattttcaaacggcctatcaatcgacccctatggcggacgcccgccataaggtcttgcgcaatacctacggcctgcttggcctgtcgatgatcccgaccgtcatgggcgccatcgtgggcacccatatgagcttcgccttcctggccggcagtcccatcatcggcatgctgctgatcatggcggtgttttacggcctggtgttcgccatcgagaaaaaccgctacagctcggccggcgtgttcctgatgctgggtttcaccttcatgatgggcgtgctgttggggcctctgctgcagttcgcgcttaaattctccaacggcgggcagctgatcatgacggccggcgcagccacgtcgctggtgttcttcgtgatggcgggcatcgcctccaccaccaagcgcgacctgtccggcctgggcaatttcctgaccgtcggcgccatcgtgctgatggtggctgtggtggccaacctgttcctgcgcatgccggcgttccagctgatgatctccgccgccttcgcgctgttcagctcgctgatgatcctatggcaggtgaaggtggtggtggacggcggcgagaacagctacatctccgctgccttgtccatctacatcagcatctacaacctgttcaccagcctgctgcaactgctgctggcttttggcggcaaccgcgactgatccagccgagccggcggcgacgcccgcaacgaaaaaccctccgcctttggcggagggttttttcatgggcggagcgatctaaaccgccaggctccatggcagcgacagcaccgatttcagctcttcctgccggtcgggccagccgccggggcagtcgcccgcggcgcacagggcgctccgggcaagctgctggcagcagccgagtatcatcatcaagtcttcgctggtgccgtgcgcgatcatgaacgcggcgtccagcatgctgaattgcatctcccgctccagcgcgtcctggaagacgccgtcggcgctgaaggcttcgatgctgatggcgatggtgtttctagacgatggcgatgaaaacagctcgatctggaaattgcctgcccgggctcgtaaaaattgcctgacgcggctgaattgcacggcgttcggttgcgggctaagcatattgcgcgtgtcggccggttgcgtcccgcagcgcttcgctggcttggcgataccatccgttcagcagggtttcggcagccctgacggcgtctctgctcatggcgggattggtttttttcagggattcgatcaggcgtatcatgtccagcgagccatgccattcggattggtgccgcagaatggtttcatgccattgggtgttttccgggcgggagatgtagcttgagtagcagccgaaatcctggatgacgtctttttgctggatgacgcggctgtgccacgcttcgtgctggtgctcatggtgttcactgaccagagccctggcgctgagttcccaatcttcctggtgcaggaatgccctgactaccagctgcttcagtggcagaaagccgctgagctgttcgatcagcacaaatgagccgtggggcagaatcgccgagcctttggcgggtttgccccggtgcggaacccggcaagggtgggttttccagtcggcgcctcgcatctgggttggcgacgggtcgtaatccgatagtttcagttctttcgcattcattttgccaaaatcttttattgggatgcctcgggcgcgcctcactgggcgggggcgacttcgttcatcatgttcctgcgtagattgctcaagaccagcgccatctcgctgggcgcctgcagcaccgccttgcgtatctgcgaggcgatttcatcggtgggcaggttgttcagcttcaggtggtcgccgatgacggcggagcacagcaggaagttgaatccattcgctttttccgtcaggtcgctcagccatttttccgcttcttgcttgtggctggctgcctgattcctcatgtagcgctcctgcttggtgatgccggcttcgttggggttgcgcggcttgacggccatgtcgagcgcggcttgctccagcattctgatagccaggcattgcaggcggtaattttcaagtgcgttttgcgtgcacatggtggtgtccccggtcgatgtcgccggcgctacatcggatttttagacggcgcggtgtgattgcctgggccggttttgcgaggctggttcgggccgagaggctcgtttgtggcttccttctgggcttcgtgagcgatgcggaggaagtggttgcggtcttcaagattcagcagcacttcggttgaatgctcgcctggagcggctgccgcgccggcgcttcccgctgccgcagcgccagggctggttgtgtcgtgagccaatctgggtctcctgaaagtggggcgttatgcggtggtttcggcgcgatgaggaggcgcagaaccggcatgtcgcacaatatcatgataaaatgttcatcataatagtaattatagtatatgtttttctttgtgggcatcaaggggtttcttcgatggtggttgctggcatgggctgggtgtggcgctggcggccactggcgcttgagcatttgagtagcggatgttttatatctatctgatttttatgtatttttgtgatttctctcggattttattccatctacctgcctaagtggctcatttttttgtagtgctatagtatgtattaaactataacaaaaattttctatgtgatattctcgccccgtgttggcgaaatgcgcgcggtcgagtggatgcgaaacgggcgcttaacgaggcgggaagggcggaaaagagttcatatgagaaaaattcaagcggtgctcaaggatattgcgcagaagaccttgctgctggccagtctgatcgacgaggcgacccgcgtcggcgtattgagccaggagcaggcggatgatctggtgcagggggtgcgcatccgggggcacttgtcgaacagtctcgaaaccatggcgtactggacggccaaggacctcaatgatcctgcgctggcggaggagttccaggaattggtgatcagcatccgagactttcttgcctgggtggatgagacggtcggcaagctgcaggcggcgctgcatgacgacagcgcggtggcgtgatggcgcgctggttattggattgctaggcttgagtcgcttgcaatgcggcgcgcgccgcgggtttgaagagagcctgtcatgcgggtttgccttggcggcgccggcgcggttgggtgcgccgctcattctccgtccctttcttgtgaaccgccctgccgtgtcccggcatgaagcccgacaaatcaggccctagtgggcttaataactccttacactcggagtaaatgattttttgtggccatgtggtacactctaatagtaatgaaactaaaagaaacagcacttttctctaggccttggcgccatgagtcttcggtcgctcacgacagtcgggtgaaggaataagaaaatgtacgatgacggtcgcgtatttctggtggctggatattgggcgaagctgaaaaaggccttcgccgccgcttctgtgtatgtgatcgcggataccgcgacgatcgcatcgagcctggcgaaacgctgcatgccgcaattcctgccggctggcgtgatgagcctcgccgaggttcgccgttatgtcgcctacatgaggcgcattgtttccggcgacgagatttgcctgatgcaggaaggcatctcgcgccagcatggcaagctgcctgatgatcaggtgtttgttgtggtcggtttttccaagaaccattcgccggatcgggatccggtggtgaatttcgttgcggcaaaaggcgaagcggaagcgacgatgctgcagcagagcgcaatgcccagcttgtccgtctccggcgtggccagcttggcgaagctgttggaactgcagtccggaatggagcgagtcgcctccggcgaaatgccggccctgaaagagcaaggtgtcattcggtaatgatcgggtctaacgcaaaagggtgtgatggatgtctacggtgaacatacctgtgtatgagcgtcaacttgcggccgttctgccggaggaactgcgaaccagctatttcaggggcgaggtgccggagtcgatgcgcgagcgctttgacgagtggaaacggcaggcctttctggatggcgggccgccggcctccatgacggaaagcaatgtcgccaaattctttttgcgcgcggaagcgctcaagcagcaggacgcgctgggcgcgatgccgctgtccacgttgtttccgatgagcagcgcgccgatcaccgccctggacgcggcagcggtgcgccgcgcggcggtcgccggccataccggcctgacccgcgaagtggtggatatggcgatccgtcccgccgacgtcacgccggtggcgcccagggaaatgcagaaaatggcggccagtttgcagcaggcttcccaggccaagccggagggcgtcaacgtggaccgcaatttgctggatttcttccagatgcgcggcaatgccaagtaccgcaaggatttgatgatcaatgtggcgctggaggaggctcacggcgccaagggtttggccgagcgagtcgagcgcaggatgggggcgttgggggaggccgagcaggggttggtcaagcggttgctgaatggcgaatctccggcggatgtgatgaaggatgctcgcgcgccgaagaagcccacatcctcgctggcgatgtagccatggcgaggttgattgcattgccggacttgtcccggcgcggttttctccggcaggccggcggcgcttttcttgcgctatccggcctgtccgcattgccggaccgctccgatgccgaggcgctggctgtcagagagcaggcgggcaatccgttcgcggccatctgggagcgcccgcgcgaggtggtcatccaccgccaggcaacgggcgagcgccatcgcatcctgttatggcatccgcagcagggctggctgcgcgatggttatgtcgaggcctgcaatctgctgcgggatgtggtggcgggagaggtgaggcagatggatttgggcttgctcaatatgctttacgcgatccagagctggtatctggccaatggcgtctacgagccgctggtggtgacctccggctatcgcaatccggcgcgcaatcgcgggatagaaggcgcggcgaagaattccatgcacacctatggcaaggcggtggacatgcgcgtgcgcgggctcagcactgcccagctgtggcagatgtcggccgccttgcgcgcgggtggggtgggttactatcccggcaaaggtttcgtgcatattgacaccggacgcgttcgttattggcaaggatagaaaaagtttattataatgataattattttaaactattattcggtcgggggcgtgcatggacagcgatggcggtgcagcggcgaatgacggcagggcatctggcaggctggcggaattgcaacgtcggctgggttgtcattcgatgccggagcgaagcccggcggcgcatgcggaccgtcgcgccgcgccccaatccttgcagacggtattgctgacgggcggcgctgcgggtttttcgctattggccgctgccttgtgcggcccgctggatcttccctttgccgcagctgccgctgccgccgcttactgcgcctggcagtcgcaccaggatgacaggcgcaggcggctggatgcctgggagagcgagcaggcccggttgcgattcgcgagggaagaaagcgcttatgatcaattgcggacattgcgcaagtcgcaggttctgcgcgcgtatgccagcttgcgcgcgcaagcgcgcaagcccatccgcagggggaggcgaagcggcatggtggtggaagatgagttgagccagacggatttgcagcagtttttcaaatcgctcaacagcgccgcgcacgatccagatggccgcgcggtttacattcccccagcgacgcccagggccggcgcgcgcgatggcggtctggaggatgaggagatcgccaggctgttcggcgtcggcggcaatcagctgtttatatcggaacagggcgcttccgagtgattttccctgtggccggcccggcgcaaccttaaaccttgcaggatatcgacatgcgttttttcggattcatcatcaaccccttgctagcgccattcaagacgctggcggcgatgcaccgctcgctcatgcctggggcgagggaaagcgggggaagcggctggacccggccggacaatcacgaagccgttcgcgtcaccgccggcaaaacctcgcggctgatctggtactgcaccgcatgctgcccgctgctggcggcgctggccttgttgaaggggctgccttatctgctggcttacaatctgatgatggcggcagccaccggcgtggtgctcgccttgcgctacgcgctgatcgcgcgccagatgcagactggcgacttggcgcagtcacgcatcggcgacgcctttcggcatggctggtggtttcccaaaagctgacgccggccgctttgggcggtccggataagaaaacggcgccgttccaccgggaaccgcgccgtttttgcatgtctgcgaagccttagtcgacctgcaggggcgagaacgacttgatcaagtcgtccagcgccttgaggtcggcgaggaaaggttccagcaaatgcagcggcagcgcgctcgggccgtcgcacttggcttgcgccgggtccggatgcgcttccaggaacaggccggccagccccaccgccatgccggcgcgcgccagttcggccacctgggcgcggcggccgccggatgcggcggcgccggcttcgcgttgctgcagggcgtgggtaacgtcgaagatcaccgggcggttgccggtcactttcttcatcacgccgaagcccagcatgtccaccaccagattgtcatagcccaggcaggtgccgcggtcgcacaggatcaattgctcgttgccggcctcgacgaatttctccaccacgttctggatttgcggcgggctcatgaattgcggcttcttgatgttgatcacgcggccggttttggccagcgccaccaccaggtcggtttggcgggccaggaaggccggcagttgcagcacatcggccacttcggccgccgccgccgcctgccagggctcgtgcacgtcggtgatgacgggcacgccgaaggcgtctttgaccgcctgcaggattttcatgccttcttccagcccggggccgcgataggagtggatggacgagcgattggccttgtcgaagctgcctttgaacacgtaggggatgcccagcttgctggtgacgcggacgtattcttcggcgctgcgcaacgccagatcgcgcgactccagcacgttgacgccgccgaacagcgtgaaggcgccctggttgctgacatggatgttggactggatgggaacgttgatcacgtggttcttcctatatcggtaaggcgctggcgcaagcggggtgccgttcggctggcccgagcttttcgccgcattgcggaacgacgacatgatatacccggtattcagccgcgcaccatcgctgccgcgtcaattttcccatctccgagctggcggaccgcggagcagtccggtttgctgttggggcttgaattcaaaattcatgatttaaatagtacaataatgccaatgaactgttggatggcggcaaaataatatgattttgaaagaaaaagcgtttaccgaagccaaggattggaaacaggcggccggcgacgccgcggaaaaggaaatggctttttatttgcggcgctattttgccgacgatcaagaggtatacgtcctcaatgatgtgaggctggaattggacggcgacgccgcgcaaatggatcatgtgctgattcatccggcgggattgaccatagtcgaaagcaagagcgtgtcgggtagattgcagatgaaggccgacgggcaatggctgcgctggttcgacgaccgctcctcgggcatggcgtcgcccatcatccaggccaggatgcagtcggaattcttgcgcaaatacctgcgcagccgcaccgcgcagcccgaggtgatagaccgcctggcgatggatgtgatcgtgtccatttccagcaagggccagttcatcccgcccaagggcatcgacgtgccggaggtgtgcaaggcggaccaggtgggcgagcgcatccgcgccaaatcgcaaggcgaggtagcgtttcccgcttcgcaccgccgcatcctgggccagtacctggccaagatgcataagccacgcgccgagccggcgccggtggagtcagccgcccccatgccagcggcagcggtggcgccggcaaagccggaagcgccggcgctgcagcatctggcttacatcggccccttgctgaaaccggccggattgttgcgcagcctgggcggcggagcggcgctgcgcaaggtgtacgccactttgtgcaagggctgccaatcgcagcggctggaattccgttacggcaaattcggttactacctgaaatgcttggattgcggcgaaaacaccgcgatccggctggattgccggcaatgcggcaagcagacccgcctgcgcaagcaggaggaatgcctgttcgtcgaatgcaaggactgcgatctatccgaagtgctgcaccgcaacgaccggccgctgcctgagttggcctgacgccatttgcggcggggcaggacatttggttttttcgcctttatagtggatgcttttccaccctgacgatgatgaccgatatgagcgacctgtccgccttcccgatcaccggcacatggccggccaagcatcccgaccgcctgcagctgtattcgctgccgacgccaaacggcgtcaaggtttccatcatgctggaggagatcgggctgccttacgaggcgcatctggtcagcttcgagcgcaatgagcagctgtcgccggcattcctgtcgctgaacccgaacaacaagatcccggcgatactcgatcccgatggcccgggcggcaagccgctggcgctgttcgagtccggcgccatcctgatttatctggccgacaagaccggcaagctgctgcccagcgacccggcggcgcgctatgaagccatccagtggctgatgttccagatgggcggagtggggccgatgttcggccagctgggcttcttccacaagttcgcgggcagggaatacgaggacaagcgcccgcgcgaccgctacgccgccgagtcgcgtcgtttgctgcaggtgctggaaggcaggctggacgggcgcgcctggatcatgggcgacgaatacagcatcgccgacatcgccatctggccctgggtgcgcaatctggtgggtttctacgatgcgggcgaactggtcggtttcgccgactttcccaatgtgcgatggacgctgcaggccttcgttgagcggccggcggtggcgcgcgggctggcgattccgaccagggattaggccaggcgccggccgggaaccgcgtccgcggacgcggttcgggctggttcaggagacagtcagcatggatatgctgcagcgctccatgtccatggtgacaatgcggccctgccggtcgaacatcagccagctgtcgttctgcatcttcagttgcactttggaacccgccggccagctgaaggcgatgtcgggagcgtcggcgccggcgcgggccagcagcgtgcacaccgcggcttcccggctcatcgccacagccaaccaaccgcggccgagcgtgacgttgagcgagccgcccgccatgtcaggcggcagcgcgaggaagctttccttctggcccggtggatggttgcccagccatggatggccgttcttgtccgccgccagccagcagtagcggtagctgccccagggcgaggggatcaccgtcgcatttttcgcgctctcgtgcacggggatgtggccgcgcgactgcaggcgccggcccggcaggctgtattgccacagctgcatcttgccgtcgtcgcccgccagctcatagtgctcgcagttcgggctgcgcatcacgcgcgccacccggcccggcaggtcgcccacttgccatagcacgctgtgcaggccgcgggccacatccagcacgcggatttgcctgtcctgtcctaccgcccagcccacgccgtcgaaactgtccgcatagcaatccagcgccaccgcgcccaggtcctgctgctcgcgccgcgccaggtccagccggtgcacgcgcaacgcgtcgccgcgccagatcaccgccagcgctacctggccgctgtccgccagcacgatgctgtccgcgggggctgggaagcggtgcgcgattttgccgcgcggatcgacgatggccgcgcccgcttctcccagcgcgaccagcagacggccgttggccagcagggcggcgtccatgatggccaggccggccagcgtcggcgcccgcagccagccgacttctttctgattttgcagcggattggggagaggagcgggcagctttccgggcaggtccgcctgcagcagcccatcctggctgatgttgagcagtgtttgcagttggcggcggctgagccggccttcacggttgtcctggtcgaccagccaatggttgaacatggcgcgggcgagcagccggctggccggggtgtgctggccggcggccagcagggcatgggcgatggccgcgcgttcggcggcctggttttcgccatcgcgtatcgccagtatccggctttcatgccggcgcagggtgtccggtagcagcagcgcgcgctgcaccagggcctccgccgccaagttgcccccggcctcttccgcctgcgccagccactgcgcggcgcgctcgcgttgcgacgcgagcggccagatcgcttgcgcggcttccagccagcgtccttgctccaccagcgattgcgcccattcctcgcgcaactggcgcgtggcttcgggccagcggctttccagttgcgggatggcgtgggcaaaggcgtggtcgcgcctggccacggccaaggcgcgcggcaggtctccggccttgcacatcagccgcacgatcagcgctgccggcatgtcccaggccagcgccagttccgccgcctggctgaagcgttcgtgtctttccagatagtccagtgcttcggcgtgggcttgcagcagttcggccagcacgaacaccgcctggtcgatctttccttcacggtcgagtttgtcaaaagtgcggcggtagagctggcgcaggtgctggttcagctcgtcgccaagctggatggaggggccggcgctgccgtggcggggcgtcagcgacaggtcgcggcgggcgttgggcgtgccgaaggcctggccggtgctggcgccgtcgccgcccagtggaatggcatggcgcaaagcctcgttgatgcggccggtttcgaacatcgccagcatctcgcgcatataggcggcctggcggcggcccagcacgcgcgataggtggctggtcatcgccgcgcgcgccagccagtcgcgccaggcttgcggcatggcttgcgccgccaggcggcgggcggggatcagcgcttgcgcggtcgcgccgcccttgcccggtttgcctgcgggcttggcgggcgcagcttggcgcggcggggcgcggcgatcgcggaagcggtaggccagcgccgccagcgcgagcaaggggaagaaatgggaagggccgccggaagatgagccggcattcgagccggcatcgtatgacggagcgggcgcgtcgctgcccgcggcgatgagaacgcccaggccgacgcaggcggccaggaccgcggcgacgatcagtcgcttgcgccacgggctttgcggcgccggctgcgcggaggcttcctgccgcggatgatccagcgcctgcaaaaactgcagttgctgcggactggccggcggcaccgcgccgcccaacaactggcgcaggctctgctcggtgacgggcgcctgctccacttgccggggcagggtgtggcggcagtcgtacatgtcgacgacggcataggcggaggcatccagccagtcgcccggccgcagcgcttcggcgtcggccaggttcagcgcttgcgcccgtccgccggtcaccagccacaggtcggcgggcggcagttgctggtattccgcttcggtcagcggcgcggagcacagcgcgcggcccagcagctgcagcggccagccgtccagctgctcgcaaagttgctcgactggcgcggcgtagcgcagcaggtcgccgtcggggaagcggtaggcgctggcgccggcatgccagccggccaggatgcggcgctgccgcgcggcctcgtcgaagcggccggccggcagccattgcccggctatccagtggcggccctgcagcagcggccggcggatctgcgcgccgatcgcggtctcagtcatgctgctctcccggcgcggcctggccttgcaggcgcagggccacgcattgttcggtcacggaatacacgatcaattctctttgctcggtcagcagtgcgatggcggcgctggccggcgcgtagctgattttggcgatgggatggatgggctggtacaggatgaggattcgcccgtcgcagagcaggcccaattggttttgcgccttatggaacagcaccagctggaaggcggtggacgcatctgcgcgaggcaccaggcccagcgcgctccaaccgggcggcagttggtagtcgatgctggccgcggcggcatggggccggccggcgtgcagccgccagcattcgcccaaggcggatggctggcggacggcgcaggcgaacagattgggctgagcgaagcccagcagcgcttcgctgtcggcggcgcaggcgccgggcactgtccattcattgtccagcggccccagagggccctggcgactcgacgccgcagcgggacgagtggagccggagggcggttccgcccagaggcgtcccagccgcagctggccggcttgatggcgaacgtacagcagcgtgcgcgcatcttgctggcacattgccagcacttcgcgcagctgcagatgggtggtgcctggcgccgggccgctgtgcacgccgcgtttgccgggcgccacccagaacaccaggttgccgacgcggtcgcgggcgtaaagcctggcgcagttgtcgtgttgcagccaggccgcatccagcaggcgggcggcgccgggcgccagttgcagcatgtcctgcggcggcagctgcactttgcccaggccggggagctggctgaaggccagcgtgtcgcccagttgcgcgaccgcgcctacggtcttgcgggtgaaggccaggccaagcgcgctgccggcgctgctccactgcacgcggcgcggcttctgccgcgacgagcggccgggtttcggcacatgcagcagcagggtttctttttctcccagcaggaaggcggcgacgtggctgccatccggcgacagcagcggggcgtggcgcagcgagaagcggccggccagttgccgggcttcggtctgggtgtcgaaattgccggccagcagcgcccggccggcggcttgtggcggcagcggcagggtcagcttgcgctggcctgcgcgatcgcgcaccacgatgtcgagcgcgtcgccgtctagcgtggggcggatgtcgacttgatgggtgaaggcggaggcggccagccccttgtccggcagcggatagcctatcagccagcactctccggggcgggtttccagctggtccagtgccgccagccattgctggctgcattcctggttgaaattgcggtagctgcgggtcgccagcaattggcgcaaggcgtgggtttgcgcgccttcgcgccactcgccgggcgcttgcaggctgccccaggcgaagtcgccgccggcggcgctggcgcggcgctccagcaggatgcacagcgccaggtgggcgagccgggcggcgccaagctgcagattgccgcagtggaacagcgccagaatgcggctgctggcgcggctttcgcgcggggtgggcgcgaggaacaggagttcgttgccggcggcgcggcgcaggaattcgtccggcaattcgtcggccagcagccattccgaagccagcaggcgttcgtatgggccgcggcgctggagcgcgtccacgccttgcggcgcttcgtcatcgccgcggatggcggcctggaagcggcccagcgccgggctgaggcggcgcagcagttcgcccacttcgggggcgagctcggcggaaaagccgctcaggcagtcgtgccagggtttgagcgcgtcgggtagttgcatgtggatcagtctgtcggggtcaggcgggggcgagccgccattggcggcggatgtcggccagcagctcggcgctgaccggcagctgccgattcagcggaatcagccgggcgggctcgcgccacagcaattgcggccaatgcgggctgcggcggtgcagcgcctgcgccagcgcttcgctgggcgcgtcaggctgccacagggccggcagccatagccggctgaagtcggcgtcggcgcgcgcgtattccacgccatccacccagggcagcgcgtgttcggggccgatgaccaccagcaggccggggccagcggtggccatcagcggcgcgcgccgctcgtccgacatgcgctccaggcgcagcagcaggcgttgggcggcggcgtcgaaggcgacggcggcctggggcggcaatgttttcgccacgggctgccagcgccagggcagggccggctgcctcatgcggccaccgtcaggcgcgcggccagctcctgtctggcgttggccagcgtttccggcaggctggcggcgtcgaagttggcgtctatctcgcgcagcagggcttcgaccgcggcgccgccgtcagggtcggccaggcaggcctcggccgactccagcaagcgggcgacgcgcgacagcggctgcacggcggcggtttccaccgcgctggccagcgtgggattggcgctggcggccaggcgctcgcgcagcgtctcgcgggcggtttgctgggcctcctgggtgggcagcacgtacagcagcggccacaggtcggcttcgccggcctcgtcgcggccggccagcgccgcggcggcggcgatcaaacgctgcgatttgacgatgcggcggtcggacagcgaaatgccggcgccgcgcaactggcggatggcgtcggccagcaagggacggaccgcatccatccgcacgcccttgaccgccgcgcacagcgtatccaggtcggccagacgcatcgcgctttccggcgcggcgtcctcagcctgccagccgccggccagcaggtcttccagctgatggtcggccaccggctcgacgaaggtgtgcagcaggaagcggtcgccgaaggcggccagcgccgggtcgtctggcagcgcgttggcggcgccgacgcacactcgcagcgggcagcgcatctgggtatggccgcggcggaaacggcgctcgttcaatacgcccagcagggtgttgaggatggcggtggagccgaggaagatctcgtccaggaagaccacgtcggcttccggcagcatgccggcggtgtcggtttccaccgtgccttcgcgcagcttgcgcagatctaccgggccgaataattcggaaggctcggtgaagcggcccaacaggtactcgaaatagcggccgcccatgccttgcgccacccggcggaccacggcgctcttggcggtgcccggcgggccgaccaccagcaggtgttcctgcgccactgcggccagcatgatcagttcggccagctggtctctgccgaccaggccacgggttgcggtgcggatgccggcgcgcacctgtgtggcggcctgttgcgacggagatttcatgatgttgacattcaaaatgcggtatgatcccaaattttccgcattgcgtcaaaatgttaatgcattgtaattgatcgttaacaaatgtgttttgcggggatgcagggatggcgtcgcatgcgcgcaaaggagacggggtggcttttcttgattttaataagtacttagtgtttaaatcgggaagccgcaaaaaagtttaaagcggcggcgataggatgcgggcaagtgtatcaaatcagcctggcgcgacgcgctggcgcaatcatgagaaggtgcgtgcatgaaacgaaagatggcagtcttgctggccggcctggctttttcttccgcggcggccatggcggctccggtggcgctggcgtattactcggactatccgggcaattacgcggcgttgacccggtactatgagaatttcaacgcggtgtcggtcgacttctacaatatcgccagcgacggcgcgatttccggcaacggcgcggcgccgccgacccaggcgctgtcctttctgcggtcccgcaaaatccccgcttacggctgcgtttccaatgtcgatggcgactggagtccggacatcgcccacgcggtgtccaccaccgcgctgaaccagtcggtggccaacttggtgaagtttgcccaggccaacggctttgccggcatcaatatcgatttcgaggcggtggcgcagggcgaccgcaaccatttcagccacttcattcaaacgctgggccgcgcgttgcatgccaagggtttgaagctgatcgtcagcgtgccggcgttttccgccaaggattacgacgaccaggccaattacggctacgacctgcaggcattgggcgcggcggccgactatctgcagatcatgacttacgacgaggcgattccggcctgggatccgggcccggtggcaggttccggctggatggaggatgacctggactacgcgacgtcgctggtgccggccgccaagatactgagcggcattccagtctacggctacgactggaagcgggctggcgacggcggcatgctgtactggaaggacacgcaggcgctgattgcccgctacggcgcgcagccgcgttacgacgcgggcagcaactcgctgaccttcagttatgccgcggccgacggcagccgccacacggtttggaccgaaaatgcccgcagcgtggcgctgaaggccggcttggtgaacgcctacggcttgggcggcgtttccacctacgcgctgggcatggagaatgccgctttctgggcggcggtgaggcagggcctgtcgcagtagcgcttaggctaagggggatgaaaaaaccgggcgcaggcccggtttttttcgtgtgagcgcggcggggcttaccaactgccgcccagcgcggcgatcaaggccacgctgctggcgtattgccggtttttcacgctccacagattgttttcggcgttgatgcgggtgttttgcgccgacagcacgttcagataggccacggtgccggcctggtactgattcaggctgatcgcttccgcccgcttggccgcggccagcgccgcgctttgcatgccggcttcctgctccagcaagctctgggcggacagattgtcctccacgccttgcagcgcggacagcacggtctggcggtagctggccacgctggcgtcgtagctggccaccgcctggtcggtttgcgcgctgcgcaggccggagtcgaacagggtcagcgccagagaggggccgaccgaccagatgcggttgggcaggctgacccagtcggcgaagctggagccgcggtagccgccgctggcgcccagcgacagggtggggaagaaggcggctttggcgatgccgatctgggcgttggcggcggccatattgcgctcggcggcggcgatgtcgggccggcgctccagcagagtggacggcaggccggccgggatctgcggcaggtagggcgcctgggcggccggcggcagcgcgaagctggccggcgcctggcccagttgtgcggcgatggcgtgctccagctgcgcgcgggtgagctgcttgtccaccgtcgcggcctgcgaggttttccattggctttccgccgaggctaccgcgtcgtcgccgacgatgcctgcggcgtactggttgcgcgtcagctgcaaggtgtcggccagcagtttttcgctggcgcgcagattggccagttgggcgtcggccaccgccagctgcaggtaggcggtggcgagctgcgcctggctgctgaggcggatggccgccagttgggcctcggaggcctgctgcttggccttgccggcttccacttcgcgccgcaccgcgccccacaggtccacttcccagctggccgacaggcccaggttgtaggcggtggcggcgccgccgcccggcgtggagacgccgcgggttttggcggcgttggccgacagggacgggaacaggcccgcctgagcctggcgcagttgcgcctgggcctcgcggtattgggcctcggcctgggcgatggtcgggctttgccggttcagcgtgtccatcaggccgttgagcgtctggtcatggaataccgaccaccagtcgccgcgcggcatcgcgtcctgcggttcggcggttttccagcggccgtcctccttgaagctggccgggatgtccagcttgggtttggcgtagtcggggccgacggcgcagccggccagcgcggcggcgcacagcgcggcgcacagcgcgcgttgaatcgatattgttgttttcgtcatggctatcattccttgccgccgccggccagcgcgttgccgaggctgccgcgccatttcaggcaccacaggcggaagcggtccaggtacaggtaaacgatgggggtggtgtacagcgtcaagagctggctgagcagcaggccgccgacgatggagatgcccagcggcgtgcgcatctcggcgccgtcgccgcggcccagcgccagcggcagcgcgccgaacagcgccgccagcgtggtcatcatgatggggcggaagcgcagcaggcaggcttgcagaatggcttcctccggcggcagcttgtgctcgcgctcggcggagagcgcgaagtctatcatcatgatggcgtttttcttgacgatgccgatcaacagcagaatgccgatcagcgcgatgatgttgaattcgccgccggtggccatcagcgccagcagcgcgccgacgccggcggagggcagggtggagaggatggtgatcggatgcaccacgctctcgtacagcatgcccagcacgatgtacaccgccaccagcgcggccaggatcagcatgggctggctgtccagcgaggcctggaacgacttggccgtgccctggaagctggcgtggatgctgctgggcaggccggtgtcggccagcgccgcgtctatcgccttggtggcgtcggacagcgagatgcccggcggcaggttgaacgagatggtggtggcggcgaactggctttggtggttgaccgacagcgaggtgttggtcggtttccagctggcgaaggccgacagcggcgtcggctggccgcccggcgtctgcaggtagatgttgcgcagcgcttccgggttttgccagtactccggcgccacttccagcaccacgtggtactggttcagcgcgttgtagatggtggacacctggcgctggccgaaggcgtcgttcaataccgaatccacctgcgactgggtcagccccagccgcgccatcgcgtcgcggtcgaagaccagcgaggtttgcaagcccttgacctcctggtcgctgttcagatcggcgaggaaggggatcttgctcatcgccagctgcaccttgggcgtccattcgcgcagctcgttcaggtcgtcgccctgcagcgtgtactggtactgcgcgttgctggcgcggccgccgatgcggatatcctgcaccgattgcaggaacagctgggcgcctggctccttggccagcttcttgcgcagccgcgcgatcacctggtcggcgttttccttgcgttcggacaatggcttcaggctgacgaacatattggcgccgttgcgctggccgccgccggtgaagcccaccaccttgtccaccgccggatcggcgccgaccacgttgatgaagcgctgcagcttcagctgcatcgcctggaaggagatgctctggtcggccttgatcatgccggtgaggcggccggtgtcctgctgcgggaagaagcccttggcgatcaccacgtacagaaacacgttgagcgcgatggtggcggcgagaatggccatcatcagccggctgtggcgcagcgcccaggtcagcgagcggcggtaggcgtccagcatggcgtcgaacaccttctcgctccactggaacaggcggccgggcgggcggctggcgtcatggtttttcagccagcgtgcgcacagcatcggcgtggtggtcagcgacaccaccagcgacaccaggatggccaccgacagcgtgacggcgaattcgcggaacagccggccgatgatgccgcccatcagcagaatggggatgaacaccgcgatcagcgagatgctcatcgataacacggtgaagcccacctcgcgcgcgccttgcagcgccgcctggaacggcttcatgccatcctcgatgtggcgcgagatgttttccagcaccacgatggtgtcatccaccacgaagccggtggcgatggtcagcgccatcaggctgaggttgttcagcgagaagccggccaggtacatcaccgcgaaggtgccgaccagcgacaccggcacggtgatggccgggatggcggtggcgcggccgctgcgcaggaacaggaacaccaccaggatcaccaggccgatggagatcaccagcgagcgctccacttcgctgagtgaggcgcggatggtgggtgtgcggtccattacttcgttgatcttgatcgcggcggggatggaggcctgcagcttgggcagcagcgtcttcacccggtccacggtgtcgatgatgttggcgccgggctggcggaacaggatcagcatcaccgccggctgcttggccagcatgccagcgttgcgcagatccaccaccgagtccttcacatcggcgacgtcggagatgcgcaccgcgctgccgtttttgtagctgacgatcagcggcaggtagtcgctggccttgccggcctggtcgttggcctgcacctgccagtgcttgtcctcgttttcgagaaagcctttggggcgattggcattggtgctggtgatggcggcacgcacggtttccatgccgatgccgtagtggttcagctgcatcgggttcatttccacccgcaccgccggctgcgccccgccgccgatcaccacgttgcctatgccgtctacctgcgacagcttctggcccaggatggagtcggcggcgtcgtacatctggccgcgagtcagcgaatccgacgtcagcgccaggatcatgatgggcgcgtcggccgggttcaccttgcggtaggtgggattggacggcatgccggtgggcagcagcgaatgggcggcgttgatggccgcctgcacgtcgcgcgcggcgccgttgatgtcgcggtccaggtcgaactgcagcgtgatgttgctggagccgagcgagctggtcgacgtcatctcggtgatgccggcgatgcggcccagcgcgcgctccagcggcgtggccaccgtggcggccatggtttccgggctggcgccgggcagcttggccgacaccgagatggtggggaagtccacctgcggcagcggcgacaccggcaacagcttgaaggccagcatgccggccagcaggatggccagcgtcagcagcgtggtggccaccgggcggcggatgaagggggccgacgggatcatgcttgcgcctcttcagccggctgcggcttgtccttgcggccgaaacggctcgccaggcggtcgaaggccaggtagatcaccggggtggtgaacagcgtcagcacctggctgaccatcaggccgcccaccatggtgatgcccaagggctcgcgcagttccgaacccatgccgccgcccagcatcagcggcagcgcgcccaagagcgccgccatcgtcgtcatcaggatggggcggaagcgcagcaggcaggcctggtagatcgcttcgcgcgggctcatgccctgttcgcgctcggcttcgagcgcgaagtcgatcatcatgatcgcgttcttcttcacgatgccgatcagcaaaatgatgccgatgatggcgatcaccgacaggtcggtgccggacaccatcagcgccaacaacgcgccgatgccggccgagggcagagtggagaggatggtgatcgggtggatatagctttcgtacagcacgcccagcacgatgtacatcgtgacgatggcggccaggatcagccacagcgtgttggacagcgacgcctggaaggccatggccgcgccttggaacttggtgtccatgctggccggcagtcccaggtcggcctcggcctggcggatggcgtccaccgcctcgcccagcgacgcgccctgcttcagattgaaggaaatggtggcggtggggaactggcccaggtggttgatggccagcgaagccgggcgttcctctatcgtcgccaccgcgtccagcggcaccggcccgccgctggcggtgggcacatagatgcctttcagcgacagcgggtcgcgctggtgctgcgggtccacttccagcaccacgcggtactggttggtctgggtgaagatggtggaaatcagccgctggccgaaggcgtcgtacagcgcgttgtcgaccgcggcggtggtgacgcccaggcgcgaggcggtgtcgcggttgatgttgacgtaggcttgcaggcccttgtcctgcaggtcgctcgccacgtcggccagcgatggctcctgttgcagccggtgcaccagcttgggcacccaggcggacaggtcgccctggctggtggcttgcagcgtgaactggtactgggtgcggctgacgcgcgcgtctatggtcaggtcctgcactgcctgcaggtacagcgacatgcccggcatttcatcggcgcgggcttgcagccgcgcgagcacggtgcggatgtcgtcgcgctcgcccttgggcttgaggttgatcagcaggcggccgctgttcagcgtggtgttggtgccgtccacgccgatgaacgacgacaggctgtccaccgccgggtctttcaatagcgccgaggccagtttttcctggcgatcggccatcgcgctgaaggagatggattgcgaagcctcgctgatgccctggatggaaccggtgtcctgcagcgggaagaagcccttgggcacccagacatacagcgccgcggtcagcgcgacggtgccgatggccaccaagagcgtggttttctggcggtccagcacccaggacagcatcttgccgtagcgggcgatgatgtcgtcgaagaacttgccgctggcgtggtagaagcggccctgtttttcctcaggcacgtgcttgagcaggcgcgcgcacatcatcggcgtcagcgtcagcgaaatgaaggccgaaatcaggatggacaccgccagcgtgatggcgaactcgcggaacagacggcccaccacgtcgcccatgaacagcagcggaatcagcacggcgatcagcgagatggtcagcgagatgatggtgaagccgatctgcttggagcccttcagcgccgccgccatcggcttttcgccttcttcgatgtagcgggcgatgttctcgatcatcacgatggcgtcgtccaccacgaagccggtggcgatggtcagcgccatcagcgtcaggttattgatggagaagccggtcaggtacatcacgccgaaagtgcccaccagcgacagcggcaccgccaccgccgggatgatggtggccggcacattgcgcaggaagacgaagatcaccatcaccaccagcgcgatcgccagcatcagttcgaactccacatcctcgaccgaggcgcggatggtgacggtgcggtcgctcagcaccgccacgtcgaccgagccgggcagggtggttttcagttgcggcagcagcgccttgatgcggtcggtcacctggatcacgttggcgccgggctggcgctgcacgttgagaatgacggccggcgtagcgccggcccaggcggccaggcgcacgttttccgccgagtccaccaccttggccacgtcttgcacgcgcaccggcgcgccgttctggtaggcgatgacgacgtttttgtattccgccgccgattgcagctggtcgttgccgtcgacggtggacgcctgcagcgggccgtcgaagctgcccttggcctggttgacgttggcgttggcgatggcggtgcggatgtcttcctgggtcaggccgcgcgcggccagcgccttgggattgctctggatgcgtacggcgggccgctggccgccgctgatgctgaccaggcccacgcccggcacttgcgacagcttctgcgccagccgggtgtccaccatgtcctccagcttggtcagcggcagggtgggcgagctgacggcgatggtcagtatcggcgtgtcggccggattgaccttgttgtagatcggcgggctgggcaggtcggccggcagcaggttgccggcggcgttgatggccgcctgcacttcctgctcggccacatccagcgtcaaatccaggctgaactgcagcgtgatcaccgaagcgccgccggagctggccgacgacatttgggacaggcccggcatctggccgaactgccgctccagcggcgcggtgaccgacgaggtcatcacgtccgggctggcgccggggtagagggtgaccacctggatggtggggtagtcgacttcaggcagcgccgaaaccggcagcatgcgccaggaaaccaggccggtcagcaggatggccaccatcaacagggtggtggccaccggccgcaggatgaacgggcgagagggattcatgccgtatccttgcgcttagttggcggccgaggcgtgacgcttgccccagtctccgctggcgccgtgcttgcggtgcggcttgccttcgctggccgccgcggcggcttcctggctttgcgcggcgcggtctatcaccttgaccttggcgccgttgcgcagcttgtccacgccgtctatcaccacctgctggccggcgcgcaggccggattcgatgatggtgacgtcgccggaggccgggcccaccgcgaccttgctgatgctgacggtggagtcgctgcctacggtgtagacatagctgcccgccttgcccagctgcaccgcggcggtcggcaccacgatggcgttcttgcgcacgcccagctgcaagttgacgttgacgaactgattggggaacagcgcctgtttttcgttggcgaacttggccttgatattgatggtgccggtgctggtgttcagttggttgtccatcgccagcaggacgccgtcggccagcttgtgcttgttgtcgcggtcccaggcttccactttcagctgcttgttgtcagcggcggcctgcaacacctgcgacaggctcacttccgggatggcgaacaccacattgatcggctgggtctgggtgatcaccaccacgccgttggcgtcgctggcgtgcacgatattgcccggatccacctggcgcaggccgacgcggccggccaccggcgcggtgacgcggctgtagtccagctgcagcttggcgttatccaccgagccctggtccagcttgaccgtgccctgatattgtttgaccagcgcgtcctgggtgtctacctgttgcttggagatggagttctgccccagcaactggcggtagcgggccaggtccagctgggcgttctgcagcagcgcctgatcgcgcagcaactggccctgggcctgggtcagcgccgcgagatagggtcgtgggtccagttcggccagcaactggccctgcttgaccaattggccttcttcgaagtgcaccttgtccagctggccgtccacccggctgcggacggtgacggtatacgtggagttgaccgtgcccagcgcgttcagctgcagcggggcgtccagcgtccgcgcggcggtcacgcccaccgccatcggcgcgccgcccttggcgttggcggcggcatccttggcgctcttgctgtgctggtgccaccaccagccgccgccgatgacggcgatggctgcgatgactaaaggcaggcggttggatttggcggacgtgggggtcgacatgcggcgtgctccggacggacgtttcacttgttattaactggcagagcatgacattttttcatgctttatgctgcgtttatgctaaaaaccgagcggcctatgccagccgcgttgtattttaagactgaccgaattgtatgagcctggttttagtccgagcgcggtttgtgtttgaaattgttaactaaaaatgagtgtttgctttctttgttggatcggtgcggatgctcgattgcctttccccatgctaagcgtttgattccagtagggctgcgcagtcaaaagaccgagccgcgaggttttcagccgattcgtgatttttacatttcatggacgcgccgaggtttgtccattgcgtatggcgctgttccgcaaggccaagaaatgcgtgcggaggggcggagccgctcccaaaattggttgcgccgccgcgcctgggagatggctggaacggggagggcagcggctgtgaggcggaattgtcgccggcgcggtacggcatgagctggatgcaagggccacagcgggtgtgacgggcgagtttgtttcttttgcgaacatgacattttcgttttttgcatattttgcctcatccgggctaggcaatgcgaacgaacgatgtcattcttttccgctttgattattcgggcccggcgatccgccagggcggcgcggggcaatcccgcgcggcagaacattagagcgagttggatatggacaagaaacaagacgcgccggaactgcggcgttcgctgcaggcgcgccatctgtcgatgatcgccatcggcggctccatcggcaccggcctgttcctggcatcgggcgccacggtggccggcgccggcgccggcggggctttgctggcgtacgcgctggtgggcctgatggtgtacttcctgatgaccagcttgggcgagatggcagccttcatgccggtgtcgggttccttccaggtatacggttcgcgcttcgtcgaccccgccttcggcttcgcccaaggctggaactactggtacaactgggcggtgaccatcgcggtggagctggccgcggccgccatcatcatgcactactggtacccggcggtgcccggcgtggtgtggagcgcgggctttctggtgctgatcttcgcgctcaactatttctcggtgaagggcttcggcgaagcggagttctggtgctcgatgctgaaagtggccaccatcatcgccttcatcgtcatcggctttctgatgatcttcggcatcatgaccgaaccgcagccgcagcgcatcgcgcccggcctcggcgtgatgatgcagggccaagggcccttcgtcggcggcctggcggcctttgtcggcgtggccatggtggtgggcttctccttccagggcaccgagctgatcggcgtggccgccggcgagtccgccaatccgggccgcaccattccgcgcgcggtgcggcagatcttctggcgcatcctgatgttctacatgctgtccatcctgatcatcggtctgatcctgccttacaacgatccgctgctgttgaagaacgagatgaaggatgtcggcgccagcccgttcacgctggtgttcaaccgcgccggcctggccttcgccgccagcctgatgaacgcggtgatcctgtccgccatcttgtccgccggcaactccggcatgtacgcgtccacccgcatgctgtacgcgatggccaagaacggcatggcgccggcccgcttcggcaagctgaccgccgacggcgtgccgcgcaacgcgctgtacgccaccacgctggtggcctgcttgtgcttcctgacttcgctgttcgacagcaacgcggtatacatgtggctgctcaattcgtcgggcatgaccggcttcatcgcctggctgggcgtggccatcagccattaccgcttccgccgcgcctatgtgcggcagggctatgacctggccgatctgccgtataaggccaaatggttcccgctggggccgctgttcgccttcgccttgtgcatgctgatcatgctgggccagaactacaccgccttcaccgccgccaaggtggactggaacggcgtggtggccacttatgtcggcattccgctgttcctggcgctgtggtggggctaccgggtcaagcacaagacccgcctggtgccgctggagcaggttgacctggccgacgcccaccgcaaggcgcgggagctgcgcgaggaaggccgcggcggcaaattggctgaggctcaagcctgaccgtcgcggcgaaagccgcgcgtaaaaatgaaacaggccctcaagggcctgtttgtcgtttgggagcgcaatgtgaaagttcacgagcgctaatggccgcttagctgcgcgttgggcgaaaaccgtttgcgtttggcgtgtaaaatgccgggcgacgtggattgaactgaaagaatcttaatgacgcctcaacaaatcgtaggcatggcggccaggctgttcgcgctgtggctggtggtgatttccttccagtcgcttggcattgccagctttctgggcgggcggcccgacagcggcgctgcggcgccattgctgtatgtgatgccgctgttgcctttgctgctggccgcttttctttggtttttcccgatgttcatcgcgcacaagctggtgccgcgcacgcatgaagccaatgcgctgaagatccccgggcgggagttgctggcggccggggcggcgattctgggcttgtgggcgctgctgcgcgccttgccgcaattgctcgcggtactgggtttgctgattgccgccgatcggccggcgctgggtttttacttcactccggaccgccgtctggatctgttgagctgcctgctggaagcggcgttcgggatattcttggtggcgcggccctggtgggtggcgcggcggatcctgccggaaggggcgccgcggacggatgcgcgatagacgcaatcccgcttggtcgagttgaattggaaagcccgctggcaagcgggcttttttgcgtttacatttacgatcctgaaaagattttaaacatctgcccgcggagctgccctaatgccgttgctgtccatcttcctgaccaaatttctgttcgtgatggcggcgctgctgcccatcatgaatccgccgggcctggtgcccatcttcatctcgatgacggcgcgcaacacgccgcagcagcgccgctacctggcgcggcgcatcgcgctgtattgcgccttgctgctggtgggcagcatgtatgtcggcggctatgtgctgtcgtttttcggggtgtcgctgccggtggtgcagatgtccggcggcttgctgatcaccttcgccgcctggcgcatgttgaacgacacgccggccgaggccagccagccgtcgaccgagccgtcgcgcggcgacagccaggccgagctcaagcagcgcgccttttacccgctgactttcccgctgacggtggggccgggctccatctcggtcgccatcaccatcggcgccacgctcaccggcagcggcaagggcatcgtccgttacgcggtggcgccgctggcgggctccgccgccatcctggcctgcagcgtgctggtgtatctgtgctacagccacgccgacaagctgctgcgctacctgggccagaccggctcggtggtgtttctgcggctgtcggccttcattctgctgtgcctgggggtgcagatcatgtgggacggcttcggcgagctggcggcgcaatggctgcgcgacaatgccgccagcttccactgacgcgggccgcgccttgcggcttttgttgacctgaggcaaggcgggaggaggccggcggggcgcagactatgttcatgacatcggtccactgaacggagacgaaaccatgagcaccagcgctttcttcatcccctcgctcaacctgatgggcgccggctgtctgcggcaggcgatagacgccatgcgcggccacggcttccgccgggcgctgatcgtcaccgaccagggcctggtcaaggccgggctggccggcaaggtggtggacatgctggctgcggcggatatcgagccgacggtcttcgacggcgtgcatcccaatcccagctgcgccaacgtcaatgccggcctggccttgctcaaggaaaaacgctgcgacgtggtggtgtcgctgggcggcggctcgccgcacgactgcgccaaggccatcgcgctggtggcggtgaatggcggcaagatccaggactacgagggcgtggacaagtcggccaagccgcaactgccgctggtggcgatcaacaccaccgccggtaccgcgtccgaaatgacgcgcttttgcatcatcaccgacgagtcgcgccatatcaagatggccatcgtcgacaagcacaccacgccgattctgtcggtcaacgatccggaaaccatggccggcatgccggccgcgctgaccgccgccaccggcatggacgcgctgacccacgcggtggaggcctatgtgtccaccatcgccacccccatcaccgatgcctgcgccttgaaggcggtggagctgatcgccggtttcctgcgccgcgcggtgaaggatggcaaggacatggaagcgcgtgagcagatggcttacgcgcaattcctggccggcatggccttcaataacgcgtccttggggtatgtgcacgcgatggcgcaccagctgggcggtttctacgacttgccgcacggcgtgtgcaacgcggtgctgctgccgcatgtgcaggctttcaatgccgaggcggccggaggccggctgggcgatgtggccgtcgcgctgggcgaggaggcgcgcagtccggaagccgccatcgcggcgataaggcggctggcggccgatgtcggcatcccggccgggctggcgcaattgggcgtgaaggacgctgatattccgttattggcgggcaatgcgctgaacgacgcctgcggtttgaccaatccgcgcaaggccagccacgaagaaatctgcgcgatcttccgcgccgcgctgtaggccgcgcacggcctctcgcctcgcaacccgccatcgcaggatggcgggtttttcctgtttttcccgccaaatgccgcgccgggcacgacgatagcgccggatggcatttagcaagcgggcggttttcaggcaagatggatgggtaatgacaaccggcttcggccggatgatgagaaagagagaagcgcatgtccgacctgcaaccatcctccctgcacccggaaacgcaggccattcgagccggccgcaccgtcagtgaattcggcgaacacagccaggccctgtatctgacctccagcttcacctacgagtccgcggcccaggccgccgcgatgttcctgggcgaagtggagggctacacctattcccgtttcaccaaccccaccgtggcggctttccagcagcggctggcggcgatggagggcggcgagcgcgccatcgccaccgccaccggcatggcggcgatccaggcgatcatgatgacgctgctgaaggcgggcgaccacatcgtatcgtcgcaaagcctgttcggctccaccaccaatctgttcgccggccagctgtcgaaattcggcgtggccacccgtttcgtcgacgccagggatctggccgcctggcgcgcggcgatcacgccggaaacccggctgttgttcctggagacaccgtccaatccgctgaccgaggtggccgacgtggccgccatcgccgccatcgcccatgagcatggcgcgctgctggtggtggataacagtttctgttcgccggcgctgcagcagccgctggcgctgggcgccgacctggtgatgcattcggccaccaaattcctcgatggccatggccgggtgatgggcggcgcggtggtgggcagcgacgcgctgatcgaacaaatctatctgcatgtgcgcgcggccgggccgtcgctgtcgccgttcaacgcctggacgctgttgtcgggcatggaaaccctgcacctgcggatggaaaagcacagcgccaacgcgctggagctggcgcgctggctggagagcctgccgcaggtggagcgggtgtactaccccgggctggaaagccatccgcagcatgaattggcgcggcgccagcaaaaaagcggcggcgcggtggtgtccttcgtggtgaagggcggccgcgaggcggcctggcgggtggtcgatgccgcgcaggtgatctcccgcaccgccaatctgggggatgtgaagtccaccatcacccacccggccagcaccacgcacgcgcgggtcagccaggaggcgcgcgaccgggcgggcatcgtcgaagggctgttgcgcgtcagcgtcggtctggaaaatgtggccgaccttaaacaagatctgttgcgaggccttgactaagcccttttaacgcgtgtttcattcaaacggcagtctaaaattggactgccgtttttgtattgccctgagtcggtgaatgtcgcgggcatggtcttgccttgacattgatcaaattaaaacgtaagtttgaaacgcttgttcgaaagctgagatgagcaagactaaaccacaagcaaatacaataaaggcactggagaacatggaggcaagccgtcccgacaccgctacccgcattctggatgttgcagaacgtctgttcgtggagcacggtttcgaggcgacttcgctgcgcatgatcacccagcaggccgaggtgaatctggccgcggtgaactatcacttcggctccaaggacgcattgttcgaatccgtgttcatgcgccggctggccccgctgctggagggctgcctgctagaactcgacaagctggaagcggaagagggcgagttgcccctggatcagctggtattgtcgttcatccgaccctgcctggcgctgtccaaggacccgtcccgcggcggcgcgatgttcgtgcgcctgctgtcgcgcacgctggtggaaaaccaccggctgctgcgcgagaccatctcccagcaatacagcgtattcgtgcaacgctataccagcgccttccagaaggcgctgccccatctggagccggagcagttggcctggcgcatgcacctcgccttcagcgtcatgttcaacgccttcgccggtaacgatgtgctgaaaatcttcacgcgcagccagatcgtcaccgcccgggatccggacatgatcgtcaaatatctggtgcctttcgtgattgccggtttggtttcgcctgtcgaaggctgattccgcgccgcctgccggagtatgacaaaagcaaggcagcggtttgcgggagtgaggggtcaacacgagggtaatacacaatgattgctgccattcttctgatcgcgctgctcggcgcgctggcgtatttcgccgcgccggtgctggcctggactgtgggcatcgccgcctggctcgccgcgctccagttcgttttccattgtccgccgtccgtcgccgtctgggcggtgttcgccgttgtcgccgcggtgctcaatatcgtgccgctgcgccgcgcggtgttcaccggcccggtattcggcatcttcaagaaaatcactccggcgatgtcgcagaccgaacaggaagcgatcaacgccggcaccgtatggtgggaccgcgatctgttctccggcaagccggactatcagcgcctgctgtcttttccggatccgaagctgacggctgaagagcaggccttcatcgacggcccgaccgaacagctgtgcggcatgatcgacgactggaagatcacccacgagctgaaggacctgccgccggaagtatggcagttcatcaaggacaacggcttcctgggcatgatcgtcaagaagaaatacggcggcctggagttctccaactacgcccatgccaaggtggtgaccaagatcgccacccgcggcggctccgccgccgtatcggtgatggtgcccaactcgctcggcccgggcgagctgctgcagcactacggtactgaagcgcagaaggactactatctgccgcgcctggccaagggccaggaagtgccttgcttcgcgctgaccagcccgtacgccggctccgacgccggcagcattcccgacttcggcgtggtatgccgcggctcctacacccacccgcgcaccggcgagcacttcgaaaacgtgctgggcgtgcgcgtgagctgggaaaagcgctggatcaccctggcgccggtggccaccatcttgggcctggcgttcaagatgtacgaccccgaccacctgctgggcgacaaggaagacatcggcatcacctgcgcgctggtgccgaccgagcacgccggcgtggaaatcggccgtcgccatttcccgggcggcgccgccttcatgaacggcccgacctggggcaaggacgtgttcattccgctggactggatcatcggcggccgcgatttcgccggccagggctggcgcatgctggttgagtgcctgtcggtaggccgctgcatctcgctgccggcgatgtcggtggcctgcggcaagctgactacctggaccaccggcgcctatgcccgcatccgcgaccagttcggcctgcccatcggcaagttcgaaggcgtggatgaggcgatggcccgcatcggcggcttcacctaccagatggaggcgtcgcaggatctggcgctgaccgcgctggataacggcgagaagccgtcggtgctgtccgccatcctgaagtaccacaacaccgagcgcatgcgcaaaaccctgaacgacgcgatggacgtgcatggcggcaaggcagtggtgctgggcccgcgcaactacctggcgcgcggctaccaggcgattccgatcggcatcaccgtcgaaggcgccaacatcctgacccgttcgatgatcatctacggccagggcgccatccgctgccatcccttcgtgctgcgcgaaatgaaagccgcgatggccaacgacggcgccgagttcgacaaggcgatcaccggccacatcaacttcgtgatcagcaacaaggtgcgcgccttctggctgggcctgaccggcgcctgcttcgccggcagcccgaagggcggcgtcaccgcgcgctactacaaacagaccacccgcctgtccagcgccttcgcgctgctgtccgacatggccatgttcagcctgggcggctcgctgaagttccgcgagaagctgtcggcccgcctcggcgacatgctgtccggcctgtacatcgccaccgcctgcctgaagcgcttcgagcgcgacggcgcgccgaaggaagacatcgcggtgatgagctgggcggtggaaaacgcgctgtacgacgtgcaagtggcgatggacggctttctggccaacctgcccaaccgcgcgctggcgtggattctgcgccgcatcatcttcccgtggggcctgacgttgaagccggcgtccgaccgcgtcggcaccaaggtggcgcgcgcgctgatggagcccggcgccacccgcgaccgccttacccgcggcatgtacgtgtccaaggatgaaaacgacgcggtcggcgtgctgggccacgcgctggaggccgtgctggcgaccgagccggtggagcagaagctgcgcaagctggcccgcgacggcaagttccgcaccatcaccgcccgcgagcgcctggccgaagcgctgcagaccggcctgatcacgcaagccgagttcgacgccgtcgcccgcgcccgcaagctgaagcgcgacgtgatcatggtggacgacttcgacatgaagctggagcagcatgatgacaaaatgctgcagcgcctgattttctaagatcggcaaagtggtactatcgccggacacgcgcgacgtgtccggcgttgacgaaaacggctgcgacgcgattgcggccgttttcgtcaacgcttagcgcccggcgggcaggagttcaagcaatggagcagcaggagcaacggattccggtcttgcgagtcagggccctgcccaccagcaccaatgcctacggcagggtgcaggccggctggctgatgagccagatcgacatggccggcagtctggacgccgaacggctgtcgcgcggtccggtcaccacggtggcggtcaacgccttccagttcgccgcgcccatcatgctgggcgacgtggtggacatgtatgtggaacggctgcggatagggcagaagtccatcacgctgaagatttcggtggaggcggagcggatggacggctcgcacgtgcgcgtgaccgaggtgatcgccacctatgtcgctatcgaccgcgatggcaagtcgcgcctgctgggccaggattgaggaaagtgttgccgtatttcccgattgttgtggaaatgttgcattaaaacgaacgtttggaacaaaagctctgcggtttggtgggattgctctaattctctggtagcatcgattatgactcacgccatgattgggtcatcgttaatgaaaatatctactcaagaaatatcagagagggaagcatgaagctcaagcatcttagcctgtccgtgatgatcatgggcactgcgctcggcctggcgtccactcaggcggctgcctcgggttatcagttcggttcgcaaagcgtctccggccagggcaccgcccatgccaacggcgcggaagccaacgatccgtccaccatcttctccaacccggccggcctgaccaggctggacggcacccagctctccactggcgtcaccctggtggtgccgcactccgaatacactgacaacggctccaagaatgtgttgggccagcccaccggcggcgacaacggcggcactttcgcgccgaaggcggtggcggcgccgaccttctacctgtccagcaagatcaacgacagaatcaccgccggcatcggcatgtacgtgccctacggcgccaagctggactacggcttcaactgggccggccgctacgcgctgaagagcatcgacctgcagtcgctgaacatcaacccgtccatcgccttcaagttggatgagcgcaattctttgggtttcggaatttcggctcagtacatggacgccaccctggagcagatggctgatgccacgtccggcctcgccatgaaggcggccgcagctggcggcatcaccggtccgtatggtccggggggggcgaccgttaccttgaccaatccggcgcagatctccgctgtaatgcgggctggcggcattggcggcgatggtctggctcacgttgagggtaatgactggggattcggctggaatatcggctacatgttccagttgaatgaaaacactcgcttcggcctggcctaccgctccactgtgaagcaatcgttgcaaggctcttctacttggacgttcaataacgtccaaggcaatgtgaccatcggcggggtgacgctgcctgccgctgtcgcggccaagcttgcgcacccggatgcttccgcgtctgtcgatgtcagcacgccggagacggcatcggccaacttcttccatcagctgaatccgaaaattgcgttgatgggcgatgtgacctgggtgcgcaactcgcgtctgcagcagatcgacatcaagcagtcgaccgttaacggcgtggtgcagggcgatctggtgttgcatcagaactggaaagatacctggcgcgtgtcggtcggctccaactaccagctgagcgatgcctggatgctgcgcggcggcttggcctgggagcagtctccggtgaagtcggatgaccagcgccatccggcgattccggatagcgaccgcatctggctgtcgctgggcgccaacttcaagatcaacaagcaaagctcgatcgatatggcgtacagtttcatcgacttcaagagcgctaacgtcaactactcggatacttgcaacccgaccggcaataacggcgcatgtaccggcaacggcggcacggtcaatggcagctacaagacctatctgcaactgctcggcctgcagtacaactaccgcttctaagccgtctttaatggcttgaaactcccgacagggcaggcgcgcagcgtctgccctgttgtcgttccggcacagtgggcggctttgttgcggccgcgccagcgccgcatgcagtttttttacaaaagctgctttgattttgcccaaaatgggttagactaatccgacataaaagcgagtgtttgatattttatcgacgctggccgatctgcaggacgattccgcggcgcgcgggccgtccgaatggtctacaaagcgggtccggcaacgggccgcgagtggtgacggaccggaagaatagcgaatatcgccggccacgctatcaagtagtacccgcctgcgccgctccagcctctggcggagcgggcgcagggcaaggacgattcaacgctcgtccttgaagcaagctggacaggttgagaggggcctgtctcatgtgtgtttcaacaaatcgaggaaaccatgtctcaaaccaaattcaatgtgcgcaaggtagccgtgctcggtgccggcgtgatgggggcgcagatcgccgctcatctggtaaacgccaaagtcccgaccatcctgtttgatcttccggccaaggaaggcgacaagaacggcatcgcgctgaaggccatcgacggtctgaaaaagctgaaaccctctccgctggcgggcagcgatgtggtggcccacatccagccggccaactacgacgaccatctgcacctgctgaaggattgcgacctggtgatcgaggccatcgccgagcgcatggactggaaggtggacctgtaccacaaggtggccccgcatctgggcgagcacaccatcttcgccaccaacacctccggcctgtcgatcaacaagctggccgaaggctgcccggattcggtgcgcccgcgcttctgcggcgtgcatttcttcaacccgccgcgctacatgcacctggttgaaatcattccctgcgtgacctccgacgcccacatcctggacaacctggaacgcttcctggtgtccacgctgggcaagggcgtggtacgcgcgaaagacaccccgaacttcgtcgccaaccgcatcggcgtgttctcgatgctggccaccatcgccaacgccgccaagtacggcatccgcttcgacgtggtcgacgacctgaccggcccgcgtctgggccgtccgaagtccgccaccttccgcaccgccgacgtggtgggcctggacaccttcgcccacgtggtgaagaccatgcaggacaccctgccgcaagatccgtggcacggcctgttccagactccggactggatgcagaagctgatcgccgccggcgcgctgggcgccaagaccaaggccggcatctacaagaaagacggcaagcgcatgctggtgctcgacccggccaagggcgagtatgtcggctccggcgagaagggcgacgacgcggtcaaggacatcctgaagatcgccgatccggcggagaaattccagaagctgcgcgacagcgagcatccgcaggcgcaattcctgtgggcatgtttccgcgacgtgttccactacatctcctaccacctgggcgatatcgccaattgcgcgcgcgatgtcgatttcgccatccgctggggcttcggttggagcgccggtccgttcgagacctggcaatccgccggctggcagcaagttgcgaaatggctgcaggaagacgtcaaggccggcaaggccctgaccgccgccgaactgccggcctgggtgctggagagtgatcgcgccggcgtgcatttcgccgaaggctcgttcaacgccgccgacaagaagctgattggccgctccgcgctggatgtttaccagcgtcagctggcgccggccaaggtgctgggcgaagccgtggcgccgctgggcgaaaccgtgtttgaaaacgagggcgtgcgcgccttcaccaccggcgacgatgtgctggtggtgtcgttcaagtccaaggcccacgccatcggcccggccgtgctggaaggcctgaacaccgccatcgacatcgccgaagaccgcttcaagggcctggtgatctggcagaccgaagagccgttctcggtcggcgccgacctgcagtcgatgatgccggccttcatgatgggcgattgggacgccatcgattcgatgatcggccgcttccagaccaccgccttgcgcctgcgctacagccagatcccgaccgtggccgctacccagggctatgtattcggcggcggctgcgaattcgcgatgcactgcgacaagaccgtggcggcgctggagtcctatgtcggtctggtggaagtgggcgtgggcctgctgccgggcggcggcggctgcaaggaattcgcgctgcgcgcttcgcaggaggcccgcggcgacgtgctggcggcgctgaaggactacttcatgaacatcgccaccgccaaggtcgccaccagcggcgtcgaggcgcaggagctgggcttcttccgcaagggcgatccggtggtgttcaacgcctatgagctgctgtacgtggccaagaagcaggcgctggtgctggcagaatccggctaccgtccgccgctgaaggtgaagggcttcccggtggctggccgttccggcgccgcgtcgatcaagggccaactggtgaacatgctggaaggcaacttcatcagccagcacgacttcttcatcgcttcgcagatcgccgacgtgatgactggcggcgatgtggaggccggcaccctggttaacgagcaatggattctggacctggagcgcaaggctttcatgaccctgctgaaaaactccaagacccaggaccgcatcgcgaacatgctgaccaccggcaagccgctgcgcaactaagtgcttggggatgattctgctgcgcgtgccgatctcaaggctgtgatgctcgccgtaccacttgtacggctgcgcttctcgccttgacctcggcccgctcgctgcgaatcctcccgcaagcacggccaatagccagatgataggtcggttgatttctaccgcttggatcagccggccgacaggagaatcgaaaatgagcaaacaagtacaagaagcttacatcgtcgccgccacccgcaccccggtgggcaaggcgccgcgcggcatgatgcgccatgtgcgcccggacgacatgctggcgcatgtgatcaccggcgcgctggcccaggtgccgaccctggacccgaaactgatttccgactgcgtggtcggctgcgccttcccggaagcggagcagggcctgaacatggcgcgcatcggcgtgctgctggccggcctgcccaacaccgtgggcggcatcaccatcaaccgctactgctcgtccggcatcaacgccgtgcagatggccgccgaccgcatccgcctgggcgaagccgacgtggtgatcgcggccggttccgaatcgatgtcgctggtgccgatgatgggcaacaaggtgtcgctgaacccggaaatcttcgccaaggacgagaactacggcatcgcctacggcatgggcctgaccgctgaaaaagtggcgcagcagtggggcgtgtcgcgcgaagaccaggacgcgttcgcggtggaatcccaccgccgcgcgctggccgccatcgacggcggcaagttcaagagcgagatcaccccgctggaagtgacttaccgcacgccgaacctggaaaccggcgaagtggtgagcaagacccgcgtgctggacaccgacgagggcccgcgccgcgaaaccacgctggaaggcctggccaagctgaaaaccgtgttcgacgccaagggttcggtcaccgccggcaactcttcgcagatgtccgacggtgccggcgcggtgatcctggtgtccgagcgcgtgctcaaggagttcaacctggtgccgctggcccgctacgtgaccttctcggtcaagggcgtgccgccggaaatcatgggcatcggtccgaaggaagccatcccggccgcgctggcccaagccggcttgaagcaggacgacctgaaatggatcgaactgaacgaagccttcgccgcccaggcgctggcggtggcgcgcgatctggagctggacatgtccaaggtcaacccgcacggcggcgcgatcgccctgggccacccgctgggcgcgaccggtgccatccgcaccgccacgctggtgcacggcatgcgcgacgccggcctgaagggccacggcatggtgacgatgtgcatcggcaccggcatgggtgccgccggcatcatcgaagtgctgtaagccagctaccttccgctacccgcgataaacccgccggattcccggcgggttttttcatgcgcgtgcccgcgctggccggatgagaaaagcctgccccttgggcaggctttcccgcgccgcgagattgcgcgtttaacgtcccatgtaacggatcacgttcatattgccggagctgcgcaccaccacccagcctgccggaatcggcgagcccagcatcaccgtgatttccgtccccggcgcggcgcccttggtatagcggatgacattgctgttgccattggcgcgcaccactacccagtcggcgggaatgggcgagcccagcataacggtaatctcgttgccatagctggagccattcagattgcgcagcgtgttcatattgccgtcgccgcgcacgattgcccagccgtccggtatcggcgagcccagcatcaccgagatttccgttcccggcgccgcgcccttggtgtagcggatgacattgctgttgccattggcgcgcaccactacccagtcggcgggaatgggcgagcccagcataacggtaatctcgttgccatagctggagccattcagattgcgcagcgtgttcatattgccgtcgccgcgcacgattgcccagccgtccggtatcggcgagcccagcatcaccgagatttccgttcccggcgccgcgcccttggtgtagcggatgacattgctgttgccattggcgcgcaccactacccagtcggcggggatgggagagcccagcatcacggtgatttcgctgccatagctggaaccgttgagattatgcagcacgttcattttgccgtcgccgcgaacgatcacccagccgtccggcgtcggcgagcccagcattaccgcgatttcggttcccagcgacgcgcctttgctgtagtagatgacgttagtggtgccggtagagcggatcaccacccagtctttgggaatcggagagcccagcatgaccgacagctgctgagtgtaggaagcgccgtgggtgtcggtgatttcgttctggttgccgctgctgcgggtgatgacccagccatcgggaaccggcgagcccagcatgatccatagcgtttggccgtaatacaacggcgcgaagcgcgcggtttgagggttggcgggctgtgcggcggaggcggcattggcgcaggcggcgccggccagcagcgctgctgcggcgatacggaacagtgtcttgtttgtcatggaatgatgatcttggcgtgcttgttgcggttggtcgaatgacgcgtttgtcgagcggtgcggggtgtccgggctgtcgctattgaaactgcgcggccggatattttaaaatgactatgtcatttattttatgagcatgtcgcaattttggcaatcgcggacgtcgccgatggattggagctgtcgctggagcgggtggaaaggacggagggaggcatgcgggccaatgccatgcgcgcttggctgcgatagggcaggcaagcgcgcggttgatggcgtgggttttggcgctagatgcggaaacggctgatcagcgtatcctggcgcgcgactttttccgacgtttcattgcaatgctgcaattgcacctcggcgacatcggccacttgctggcctatctgctggatattgccggcgctgtggctgatgtcctgcgccatgccgctttgacgctggatggtgctggcgatttcgctgtttttgcggttgatgtcggcgatcacgtcctggatgcgcagcagcatttcgctggtctgttccgcctcggccacggtgtggccggcgcgctcgcggctttcctccattttctggtgcgcttgccccaccccgcgttgcagctgctctatcgtgctgcgtatctcctgggtggcgctctgggtttgcgacgccagcttgcgcacttcgtcggcgaccaccgcgaagccgcgccccagctcgcccgcccgcgcggcctcgatggcggcgttgagcgccagcagattggtctgctccgccacgccggtaatcacttggacgatggattcgatatttttgctgaaggcggccagctcgcccatcgattgcgaagtttcctccatggtctgcgccagtttgcagatggactgggcggattgggccacctgtttcacccggccatcggtttcctcatgcgcctgcttcgccgcggcggccacggcgctggcattattgttgatttccccggtggtgtcggccatttcctggattgccgatgccaggccgtccagctcctgctgcaggcgggcggcctcgttgcggctttggcgggcttcgttggcgctttgctcggtgctgtcgtgcaccgaatgcgaaatccgctggatgtcgccgaccagttgctgcaggtaggcgaggaaggtgttgagttcgtgggccacctcgccgaattcatcgctggcggaatcgtctatccggcgcgtcagatcgccgttgccgctattgatttgcgccagcgatgacttcagctgcagcagcggcgcctgcatcagccgccccatcaggctgctgagcgccagcatgctcaggattacgcctatcaccgcgcctatcatcgcctgctggcccagcgagcggacgttggccattaccttgtcggtgtccaggacgatgcctaccagccatttggcgttttgcagcttgtccagcggctggaaggccaccatcagctttttgccgttcacgtcgatgtcttgcagatccttgctcaaggccggcgcttgtccgccgaacaagtcggccaccgatttgccgttcagcttgccgtcggggtggctgatgatcttgccgtcggccgacagcaaaaaggcataccccgcgccgttgaaattgacggtgttcagcgcttcggacacggttttcaggctgaggtcgccgccaaacgcgcccttgaccgcgcccttgtcagtgagcttggccaccgccgagatcaatatctcgccggaggcggcgtcggggtagggatcggtcagcgcggcgccgttggcgttcttggccaccggataccacgggcgtttgcgcgcgtcccagtcgggcggcgggttccatttgggatcgttggtgattcttttgccgtcggtgtccagtccgccgaagatcagcagaaactcctgcttgtgctgagggcggtcgaacacttcctgaatgcgctccgcgctgaagccggagtctatcagctgcgccatcaaatctatctgtttgagcttgccgttcagccagttttcaatctgcgctgccagcacttggccggtttgggcgatctcctgctgcttgtcgcgcctgacgctgtcggcgatgctgcggtactggatccaggacagcgtggacacggtgacggccaggaccagcgccgagatgagtcccgctttgtgagctattttcatgatccgacccttgccgtggcgctaatttgatttaggttagtacattttgcgcaatggaccagccgcggccgcaagcctgtccggaaggctggcgcggcagtctgctcgcaaggggggagatgaaaaaaagccgcaggcgcggcatggggcgggagacgggcggcatggccgcccttgctcaggcgtgggcctggtatgccttcagcacttgcaatccgtgggtttctgcgcggacttgatcatggcggcaaatcatcctgctgttcccgatcagagcctgaatgccggatagcaggttgaagcgggcaggcacgggatagcccaggttttgattcagcggacggatatgaagcaccgccgccatgttttggtactcctcgggcgtcagcttgccggagtcgagcatgctcgtcatcacatcgtgggcttagtccgtggagaggttctccaagttcagcttgccggccgctttgggagcgggcgcatccgactgcgcttcggtcagcattcggacaaatccggatgcctgcgcggcgtcggcgattcggggcgcggatgccaccggctttgcggaaagcgccggggtcagcattttttctccgttggcgactgtcagcgtaccttcaaattagcccggtagacatagcccggcgagttgatcgggatcgaccaggattcaaatgctcaagtcatggggcatggtttgcctacaggagccggggcagtccaggggcaggccatgcgcgtttctggcaaaacagcgtggcgtgtcttggttttggtttgccggcgcggatggcaacatggtcaaggtgacttgccagaagccatggaagcgaactgatccggtggcggggtcagtatcgttgacgtgtacgtttgagcaggtgtttgatgctggttaggtgagttttacggcaaaacggcaagcatattgcttgccgttttgcatgcacctaccggttagagtttgatgcagtagaaggggccgctaggccggccataacctttgttggcatagaatgcgcccggggctgaggcgatagcgtaaagggaaacatctagctcggcgccagatttctcatcattccagatgaggtctcctgcggaggtctccgagacgaggtccctgcggatgcagcggtagttgggaatgtagggcttgctgtaatcgctctgcgctaccgagccaatggctacatagcctgccggagcattcggcagccagatggagccatcgctgctgccgccgcttcctttgtcggtccatatcagagtgtagtctatcggcagtgccagcaaaggggcagagccatcgtcattttccacctctaccacctggattgccccactccctgatttgccgtgatctccctgggcatgatcgccaatgatgtactggttgggattcgtcggagccggacgccagatgctgacatccttggcggagccggttcctttgtcggtgtagatcgggtcatgtaggtagttggagattgtggtaacgatcaatctggcggatccagcgttcaggatttgcttcacgatttcgggcgaattcatatgaaactcctaacggtaagtaagtgtgaaatgagtgatgttaattcactcataactaattttgcattaattcagttgttatgccttgttacttgtgacagttgtaaggaagataaataaatgcaaatacagcaagacgtccaaggctttgcccttgatgcgcgcagtctgaggctcggcatgccggctatgggcaatcgtttgctgatattcccaatacgcatgtgaggaacgtgacggtcgtgcggagtggcaagtatcgcgcttactttggggagtaggggatgggtgatgaagtcgtgctgccgcgggagaatttccgggcactgctggaggcggcggccaaggctggcgcgcgccaagcgtttgatgaggcgggcgtcgagtatgcggtgaagctagccacgagagtagatggcgtagcggatgctgtgctgaaggcgttggccggcggcattgtgatcggtctgctgggagcgatctgggccgtcaagtcagtccgaagcgcttcgtgcctctcttgccgatgcaagcaagacgtccgggtaatttccgattgtgacggtatcttgcttgccgtctgccggtcggcagtactgtaggcgccacgctttcttgccgtggggatcacccacacagccaacctgccaccatcagacagcttgataacggcaagaccaggtttggcggggttaatcctggccgtggtaagtggagcaacgagttttggcatgttgggatcccgtaccgtcacggcgcaagcttatacgaacaaggctaccgtcaaaacagattgatgtgtgctgattgccgcttgccggaaatgaaaaagccgccagtcatagcaagcaaactcaagggtttcgcttactaccgctgacggcttcttgctgctatttggcggaggctgtgggattcgaacccgcggaacaatccagcatccatgcgggtttcgcggcgttggctattaacttggggcgtatttggggcaacccatcaatccccatgccgcaaccacctcatctagcataccttcaccgctcgtcggatgccacttgccggcgacgctcccctggctgtagtttgaaaacgtacgaattcaaattgcagaccatcatggaacccaaccgcaccccctataccctcgacctactgagcgacgagctcgacatggtgatccgcgcgctcaaatctgggcagccgaccctgtgggaagccaagcaactgacccagcgataccgggaggttttcatcgaccagactcgcgatctgctgccggcccatgagggctgtgagcaaaccgtcgccggccggctgctggtcgttcaggagctggagctggcgctcgaccgcttccgcgagattggcgtgtcgccgaaaacccggatgcgcgatgtcccatgcctggacaccgcgctgcgctactcgctggatgaggccgcagcggggcgccctggtgggatttcgttccgatgaaatttaaatctttatttttttggggccgtggcttccagattgttgttcaaggaggcagcattattcacaagtcttatcgtaatctgagcaattggtgtatcaccttcattgacccaaaaatggagtactccaagaacctgataagtctcccccggtatgtaaatgtactcgtcaatattaggtagccttgagaactcaacatagctactgaatagaaaagtgccgttttccagtatcaagtaagcgttattcattttgttacctcgcgatatttttaatttgcaaaaataagcatttgcacgtatttattgcaaaccgcttgtgaccgcgagtaaagcatagtcaatagattgccgcccatctatgcgtgctattgactaatgcctagagacagaaaactattgagatcggtcagtcctcagtattttttggcaggcgttgagctgccggacgacgtcatctgcctcggcggcgagccggagagcatcgtctccatacgctgcagaaaagtcgcctcccgcggcaccatcacgctggccggcgccggcggcaattgcgggcagatcgccgcgcccggcggcgggttgctgctggcgcagccggagagcagcagcatggcgagccagagcggcttgcagttcgagttgtccattttccagatccttttcgtaggcggccgccgtggccgcatcatctactgccgcctggtgctcgcgcgcccgggccgcctgggtggccgctgcctgctgctgggcctggctggcgcgcgccaccgcggcgtcgcgctgggcgatcacggcccgcatttcccagcccagcgccagcagggcgacgatcaccaccagcagcagcgcctcgcgccagtatttcagcagcgccagcatcagcagggctcctgaaaaagtgcctgttccgccaggcggcgcttgagcaggccgggcaactgctggccaccggcgcggtcccagcgcgggaactggccagcggcgccggcgtagtcaccagtattcagcagccgcagcagggtggaggactgcagcgagcccaggcccaggttgtaggtaaagctgaccagcgccgagaactgattgccgttcagcggcacgctcaccagccggccgacgccggcctcgaatcgtgccaggtcagccgccagcagctgggtggcctgcgcctgggtgatggtcagtccggcgcgcacgtccggcccggtgtggccgtagccgatggtccagacgccgacgacgtcttggtaggcctgcaggcgcaggccttcgaactgctggatcagggcgatgccttctgcgttggttttcattgcggttttgctcccatttttttgcccacccccaggccggcgatcagcgcgccagcgccgatgccatagccctgcaggtcgaacggtttgccctggatggtgcagtacacctgcaacccaaggccgatagcggtggcgacgccaccccagatgtaggcgggctcaagctggccgtcatcgtcggtcagcatctcggtcaatctgctcatgcgcggtccttatgcggctttgaggtcgtgggggaatgccggcggtgcgggcatttcgtcgggggtgaagacgaagcccttcacgcgcgggaaggcctggaaaatccactccggcaggctcatttcgtggatgccgtggtcgcggtggcggtggaatttgctgtgcagcaccagcatgttggccatcgagtcgacgaacagctccggccgcgccgggtcgaaggcgcgccagtcgaagcccttggcctcggccagcttgcacagcgcccacagcagcgaatgctcagccgagaaaaactggccggggatcggctgatcggtcagcaggtccagcaccggcagttgggtgatctcgcccagcgccacgccgcgcacggtgcgccagtcgacggcgccgctgaatgcccactcgcagagcaggtggtggtactcggcgccctcggtgtggccgctgatggcgcacggcagccgggcggcgtggccggccgccttggtgtggcggaaggtggccgactcggtgcgcggcggatggtccggatagaacacgtcctcggccagggtgtcgtggtgggcgtgttcgttggccggcgcgccggcgacggccaggtgttgcttctcggtcatgtggattgtctccagaaacgaaaacacccgccgggtggcgggtgtcagtggggtgggtttcttgctgttatcggccggcgttcattcggctcatgctggcgcgcatgtcctcgcgcagggcggcgatggcttggtggatgtcctgcttcatgtcgtcgaccatgtcgcgcaggtccacgcgccggcagtattcgtcggccacgcggactcgtaggtcctcatggtcggcgcgcagccgctcatgccggttatgcaggctgatcagccaccagcccagggcggcggagaacagcgacagcacgccggtcagcgccgtcagcatcaattcggcctggctcattcaatcccctttggcaaaaaaattcccgcgcgcggcgggttgttggtttggtactgctggtggtggatcagctccaggtgatggcctgcaccgcggcgacggtggtagcggcttggactttgatcatcaggttggcgtatttctgctgcagcgcgccgcgcgccgccacccagtcggcgttgacctgggcgagttgggccgcggtgtgctgctgcagcgaccacgcgccgttggcggcgcaccagatgccggacgtccagccggctggcgccgtcggcgcggcggcgacgtcactggccagattggcctggtcggtaggctggctggggtactggtgcggtgcgccgagggccgaggaggtgaagccggccgtgattgccgcctggcagccggcctgaagctgcgcaacctgggccgcctgcacctgggccagcgtcggcgccggcggcgcggtcagcaccgggttgccgccgctgtcactggtgatgatctgtccggcggcctgcccggccaatagtgcctcgtgctgcgcgtcggtgatttggaccgcatccgatggcatggccgcgccatggatttccgggtcgtagaacccgccggtggattttgcgtaatagatcatggattagttcccgatggcgaaccaggacacggcattcccggatgctgagctgtttcgtaggtagaaagacgttttggggctggcggtattgatggaccaactaccgtaaatggcgactgaggatccgaggttatacgcctccccgagcagcacctgacccagttgattcggaaaggcgatggggagcgttaccagcgtgtcagatgcagatgccacgctcgccgccccccactgaaaaatcaggccgctcggtagtttctgatatccgttcgatccaatgctggccgcgccgaaaccgccggtaactacaatactggtcccgtcgaaaacacacctggcagattgaccggattgcaaggtgacggatgcaacgctcgcactgttatagaaaaacgatgcgccattaccggaaatcgtaaccgggccattgccggtgttgatgtattccatcgcggcaccagccggcacaccgttgaaacttggcgtgttcagcgtgaagctgccactcaactccaccaatttgccgatgtcggacagcggctgcgtggccgccgcctggtagaggaccgcgcccgcgttgctgccgatgcgcgaggcctgcgccagcggcgcgacagcgttcgccagcgcattactggtagcgtactgccccaggttcagcgcgctgatcgcggcggagagggtattttgcgtccagttcgtggtggcattgaggttggagctatcgccaaccggcggatttttgctgtagcaggacagcagtacgatgtagttgtgggtgtcgccacagaccagcgcgccgtagcccgggggcaggttgaatgtcgcgccattcgccggaatgccctgaccgaaaaatgcccctacggccgtcgccagagtcagctggttggaggtggatccattccagaaataggccaggacggggatggactgagtgggatccggtagggtagctgtgcagtctacggtgccattgaactcgaagaagctgtgcgcgggaagcttgaccggcccgcttttctggatgaactggacgttgatgccaaccggcgccagtccgcccaacacctgggcaagctggttgtttttgcccttggtcggcactaggccgccagcctggatcgcattcaccagctccatcatgagcgtgttcatgaaatcagcgcgcagcaacgttgccggctgaccggacgcaggattgccatcggtgaaatagccggccgtgccagcagcgcccggcggcggcatttgcgaaacggcagttggatcgtcgtattggtacatgttttcctcaggcgtagttgaactgtaggatggcgtgcgccggcaccagccggctcaaaacctgctgcagcggggcattcccccagctgttgagcggctcgcccattgcggattgccccatccgccacgaaatcaccgtctcaagaggggcgtggaccgcccaggtgtgcgcccactccgggccgccaagctggccacccatcgccgactgccccatccggaacggcgcaaaattcgtgatgctgatggtgtagccgaggcgggccgccacctgcacgaagtacgccgcagactggccgccaaccgccgtcagctgcgccacaacctggccgcgccggccctgcagcgtcgtcgccggccccaatactggatccggcaaacccagcgtggactcccattcgggcagcaactcatatgcagtcgccgggaacgcgtccaccagcaggttgttggcccgcgcatgcgtgcggccatacacctgcgccagcgccagcgctaccttggactggacggcgtcaggctcgcgcggccacactcgcccgcgcggcagcaagcgctgcagcgcgccctggtagtccagggcggtgtagttcgggagcggcataggacctcactgccaggtaatagggcccagcaccggcagatagccggtggggctggtgatgtcggcgcccgacggagaaaccacgatgaagtcgctcacgccggcaaccgtggcgatcgccgaccagatcagctgcaaggagatgctgccgcccggctggccatactggaaaaacacgccggcaatggccaatgcaaccgccgcctggctggccaccggcacgcccttgatggtgaatggcaccgggttgctgatgggggagaccacatagaccagcgccgtgaccggctgaaggggggcgatggcattggcaacggtcagctgatcccccgtcgccaccacgccgcgcggcacgccgcccgggccctggtcgaactgcgacacgccattgctgccgaccgggaagccgccgttggcggactcagcgccgtccagcatcacatacaccaccaccgtccccggcccgaagccgttcggcgcgcaccaggcgcgggaaacgccgggcaccgccatggcccaggtgatgtagtctttctgcgcgccgccctgcggcgtggactgaaaagcggatagcactcgcgagcgatagggctcgtcgccctccaggtccgcgccaccagtcagcgccgtggcggccaccccggacgcctggataccgggcagcgactgcgccagggataacaccgtacctgcaggtgaattgcctgccgcccccaccagcccaataggatccggcacggcagagataggcacagtcacggagctgttcgcccctaccacgccagccgctgtgacgatgtactgctgcccatcgccacgggtgatcagcgcaccggatggcaattgagcattgacctgaccgggaaaagtggctgcgccagcggccggggtagcaggcttgatgtaaacgcccttcatcgcgccccagccctgcaaaaactcgccagtagccgtccagggcgtggattgcttcgctacaaaatcgatgtagtcgtaatggccatacgccatggccgcctgagcggacgccatcacgcccagattgctgaaccgcagcaggccgtcgccgcctggcacattggcggcaatgtcctgcgcgacttgctgacgcagcgcggtaagggttggtgttgcatagggcatcagttcactccattccaggcccacttgaattgcacggcgctgcgcgcgccggccgtgctgtatgacacaacctgcgcgcccagcgtggagggcgccacccactgcgtggtgatgtcgaatttggctaccacgccgtcgtcgatcagccactgcaaggcctcggcgatgtaatcgcgggcgcggttggcggtctcccgggtctgtttggcacgcgccagcaaccacaggcgcgagccgatcgggcgcgcggtgtcatccaggcaccacccgcgcgggtcgccgctgccatcgggaatgacgtcgtccgggccggcctcgcggtcagtgcccaggctgagcaaaatggcggattgcaagtcattgccggccaacaattcagaaccggccagcacccagtcgccatgcgtgccggccacccaaacggtggaaatgtccatgcgctattcctgctggttgggctgttgcgtggtgacggtcgagctgccgccctgaacgccttgcaccgcgtggttgtggccgttgaagatgccacgcatctgcgccatggagtgggcattgctgccggcgttgtcgatgatgtcgccgccggccttgatcagcccgctcacatccaactcgggcgtgttgagcttcacgccggcgctggcgttgaccgtcaccgtgggggtgttgttgaccgtgagcggcaagccggcgccattgacgacgatgccgccggcggtgagatacaccgactggccgcggttatcgaaaatcgccacctcacccggcttcaaacctgtcatccggctgccctggtggttggtggccaccaccacgccgttgttgcggtcgcccagcgggaacagcacgacggcgtcggatcccaccggcgggtggctggtgaacccgtaatccgccagccggcgcaggtggtcgcgagtctcgtcgcggcccatctggacctgcagcacctgcaccgggccgccatcgctggccggcgccgtaatgcgcccgcggcccagcagcatccagacacgccgcgccagtcgctctatctgctgaatcatccattgcctccttgggcagcgccggcgacaacgtcgcgcatggtcgggaacaggttgacgggctggacggcgaatgcctccggcggcatcagcgtcaggtcggcatgcgtgccggtctcgtcacggcggtaggccacctcagaaatcagccagttcgcgcgcggcacatgcaccgtcggcgccaccagcgtcaccagcgtgttgggctgccacaggttgccggcctcgtctcgccagctatccacggttacgtttgcctgtgaactgcgaccagcacggcggacggcttcccagttgacacgcgccttggtgatctggaaatcagatgtgtctcctgtctcagcgatgatgctgcgtacgcgcagtcgcggcacgccggggtcattcaccactgccacaacgtcaggaccgacccccacgtcgctcatcatgtccattggcaagctccggccgatgtactggctgaagcgctgcgccatggaccagcgcatggtgatggactcgatgttgaccccctccgccaccaccgggtagcgaacgccggcagaggcccgcatcgcctgcgacagcctcaacgagccatccggattttcgtagaccagcatctggctgttgcgcgccacaggctccaggatgttgtaaggggtctccccccacggcagctgccataccggcaccacctcgccggcgccgacatccgacaccacatcgatgccatagggcgtggccaactggatggccatggccagcggggtgatgttggtcatctggcagccgttgaaaaagtggctgcagtcgaccaggtcctggcatttgccgcggccgctgacagctatggagtgcgccccggaggacagtgcgggagtgaaatcatccacgtagcccgtcactacgatatcgctgcccagaagcacctggacggggtcgcccggattcagcaaaaagcgcccaaattctttcgggtagtgctcggtcatgccgatctggaagccggatgggaagcgctcaattccgcgcacaacattgacggtggtccaaccggaaatacgctggccgttggtaacaagggtgaggtcatccataatgtcagctcaatgtcatgaggagtgggcaatgattggctttttgcttgtgatggtgatgtcggatggctggcaaggcggcgttgtgccgcaaggcatctataagactgccgaggactgcctgcaggccggcccccggtgggtgctccacaacaacaacatcggtcacccgtcgacgttttactgccagaaaaaggcggtgccgaagggccagcagtggagcgaagccggcatcacgccgcagatgcgcgagaaatgggccaagcagcaggcggagaagtacaagaacatcacctacaccatgccggaggacccattctcagcatctactgagccagcgcattgaactgcgtaggcatgaacagcgggtggatggcgccggcctgctgcgccaactcacccgcgcgcgacggatcgcgatagagccgctgcgccagcaccatggacggcatgggctgcggaatggagaccggcatcatgcgcgccagcgaaccgccgcgggccgtcaggtcggccaccaccgcggtgcgcagatcacgcaacgcctgatagctcgccatactcccggcgtctgccgcggcaaccgcctcccgctctaccaactgcgacacccggctcctcaatgaggcagcgtcgtcatagctggtcggctggtaggccgatacagcgcggcaaacgccgatcaccgccgcgcgccgcatcatcgctaccgtctgttgctgcgcagtggtcatggccacgcccatgggcgaggtatccacgccctgaggcatgggcagctggctgagcgcagtcaatgcgttgatggcgtccatgggactggcgctcgccgcgaccagggcggccaccgattgcgacacggccgccggcaacggctgaatggcggcagcctgggcgccaagctggccggccgccgccgacaccgccgccgccgaggccgttaccgcttggcgttgaatagcgctggcggcgacggcccgccgcgtgggcgatggcgtaggggtgctgggcgcggccacgccgcgcgggtcgccgtagcgattggcgaagctgtccagcgtctgcagctggccagcgacgccggccactgagttgtaaatccccttggccgcgctcactacctgattgatgcggctggcccactgcgccgcagtgctcaccaccgactgcaccacagcgaccccttgcttgacctggccgatgagaccggcgacaaaatccgcctcaacagacaggccggcctcgtcggccagattggataaccagctggaagtgtcttgctgctcgtccggaaactcgcggtcgccggactcgacaaactgcatcgacagctcaacgtagcgcccctggtcccagcgctcggacacgcgcatcggccccaggctgacgtagagcgtgcccagcgtgggatgcaccagctcgccgcgcccctcctgctcagccgcggcgatcatctgctgcatctgactgatgacgtcgtcgccaaccaggaagccgatcaagttgatgcgccgcccgcgccggcccatatcctccacccacagcacatcccggttcgggtactcgtgctcagccagccgacggccgaattcaccatcggatgccagcacggcgaacgggatgccgcggtagctggccggccgcaactggtcccaaaaggtggcgccgcccaggcccagcgcatccgtcagctgaccggccgcagacaccacgccatccagtgcgcccgcggtgcgggtggcggtgttcaatacgtcttggaagctcattgcataccttatggaagtgagtagaatcgctttgagatttaatttggagcttattgttatgtctgaatggttggcgctgccgataatatttatttttatgctttatgttgtatttgagtggccactatatcgctacccgcttttaatgcttattgcggggattgcaatttgcatcttcgcttatcaggtcggagccgtgcttgaatttgttcaacttaaaggtcgacttcctaaaggggttgatattaaagaggcaattgctgtgacgtccttgtctcttggggctcttggcggaggtgttgtctctgcggctattactcaaaaagccaagcagtcttatgttgataagatcgaatcgttggagtctggtatatctctgctggcttatgaaataaaagaaggcaggaaggcagaaaccactgagggattaatttatgcgcttgacaaagaaaaagagcttggacggctagagagaaaaataaaagcattcaaaaagtatttgtgaataaaaaaccccgcagaagcggggttaaatatttcagagtgattactttttctttgctggtggcttttgagccagcgtagagcctgctgcggcttttgcattgcttccggtgttgttacttctcagcaccttggaggcttgggttgccgcggggggagaggtaacttttccaggtgctttggtctgagaaagagcgctacctgccgcagcttttgatgctgggctggtagatttactcgtcagtgttttggcggctgcagtagctgccggtggttgtgttacttttttgcgcggatcgtttggcatggagacttccctcatatggattttctcatatcgacagaccgaaccttgccgatatgaaaaggtatcattgccatgagtgaaacgtgaagatgacagatttcagtagtcgagaatatctgtatacataactaaagagcgtggcattttgaaccccgccggagcggggttctgtcatttttgctctacgaccgcctcttgaagcagtccgaacatcccaacgatccagcctttcagccgatcctgatccgggggtattctctccggactcaagcccaggcgtaggagtagggcgctttgcaacagcctgaccaggtaaggaagaggatcctccgagcggttggcaagtgctgctgccaccgcgaaggccaactctccctctgcgttgccggcgctgtaggattcgtcatcctccatgccgtaattgtcggccattccctctgcggcccgcatcagaccagaccggaatccggccacctcaacacggtgcccggtcatcgcgatctccctgttcgaattggacgctcttcgatgactgcaaagtgttcagctttccgcatcagctcggcaaggtcatccagtgctttgttggcttcggcactgatcccgtcttggggagccaagtcaccatttccgtgcaggacggaaatgtagaatgcctggttgaagatcttgtccttcagttcctgaggaagacttgctgcatggatcacatgcgcaggaacgatcttggtctcaaacagagtagtcacgttgctcatgctgacctctccgccagtcgatcatttgcaggcagctcaaccgcgaggttgttgatcagcctgtggatgtaggtcatgcctttgccggtgaccacggttttctgccccatctgaagctcgccgcgcttcctccagggagaggggatcacacggaagtagccttgatctatgaagcgctggtagggctcattgctttgcatcagcactcctttctccctcaggaaggcatagaggcggttgcggcccgtgcccaactccttggcaacttcgtccatggtctggcagttgatggtgttggcaacgtcatcgtggaactgcaccttgggcgcctgttcagcgaccttgtgctccagcagtactttttgctgctcggcgatctgccgaccctccaactggtcggcccaggcgcgcgccgcggccaccgggtcttggaagtcggggaggactggggctgccaccttctgttccaattccatccagcggtcaatgatacgtttgcgcagcctgacgttgtagccggcgatcagtgtcagggtaaggtctttgggaaggctgattgaggatgtatatccgcgtagatccttgctctcctggacatggctcaaatctgagccaccccccagctcatcaagcatgacacggatatcacggatcacgttcttgtgctctttctcgcacagctcggcgatctcacggctgctcatggtcatgggctggccattcatggttaccaggttcatgtggcatccccctcgctacgttccatgtttttcagtgcgagttgcaggccgagcaatagccgattggtctcgccggagtactgcagggagcaagtcccgtcatcgaagagcttcaccgtgatagaggctgccacgggcttgagttcctgttcgtggttcatgatccctctcctcacgcggccaaaatgtggttttggatctgctcgcgcagtacgtctgcgtcgttgtgcaggcccccggcgatccccttggcgtggatcgcgatgccgcggatgtcggcatcgtcagcagagaggcgggcgatggcgctcatcagggtgcgcagatcgtccagttggacggtgatgaggtcgagggactcgacactgtccgccagaacttgaacaggcgaggtgagtgtgctagatttcatagcgaattttccttgaattgcgttcaggatgttcgataccgaagcctcaacagttcccgctgttggggcttcaaccatttctgggccggtcgcttcaggctgccttgtcaagttgctcctcctctcgttgaatctccttcataaccagatcaagtagtaccgagttcgcgctacgatactgacttgctgctcggttcttgacccaatcctccgccttcttggggaagcggatctgagtcctccatacgtagttcagctcttctttcaccatgtcctcccatgttttgacactattttggtgtcgtgactctatggtagtgcggcactataatggtgtcaataacttttgacacgaaaatggtgccgtatgtctgatgacggatacacgcggatcaccctccgcatcccgactccgcttgatgagaggctcactgagtcagcaaaggcgacaagcaagtccaaaaacgctgaaatcgtcgaaagactggacatgtcattcaataggtccgatgacaagatcgttaatgatcttgcaaagacactaagcaagatggaggagcgcgtttcctattcggacagtgttgcaatttcctatataaagacagcccaaatccttgccaagtctgttctgttactacgtgacggaattagcgatggggctctcgcgcccagcatggctaggtttctagagggtacggcaagcatggcagagttcgtatcagaatcttcaattgacatcacagaatcacagctatcccaggtgcgtgcactcatgcagaaatatgcagaagacggcgtacccgactatgtcatatcaagagacccgattaagccatagtttcgtcgatcagttcagcagcagcgagggctggatcgcaccttccagcaggaaccgctccgactccagcctcgggatctcgcgcttcctctccagcatcaggcgcgagccgaacgaggctcgcaccttcgattccacttcgcgcgcgatcagctcctgcatctgttgccacaggcccaggtcgcggcgcttcaactgttcggccatggcgttgaaggcgttgatgtagccgatcttgacgtccagcgccttccggccggtgaagcccatcaccaacaacacgaatccgtccttggtcatctggtagcagtcgtaccgctggccgttctgttcatccaggtaggtggcctcctcaaaattgagtagaccccatgcgcccgactctgcggcaagttggcgtacggcgcgcaacacgttgtcgtgccgcttgccaaaggccttggccacgcgccggctatcggtcacgatcttgtcgccggccagcattacgaagtcgttgaagttcgaaacaatcagttcgttcatgtcacgctcctaacacctgggaaggggagtccagcggcaggcagggcaggtgtacaccccgcttttcgggtcgcgttccctagccgtggacgaaaaaaagccccacgtcgaaacgtgaggctggcaaagacaaagccccgcggttgcggggccttttactttaagccgttgctggcttagcgcttgcgatagtggtcattcgttgctttgttcttgtagtggccgcccttgtgcgaggagcctttgccgccggcgtagtggccaccgccgtgcttgccggcgaaggagactgccgggagggctagggagagggcggcgatcagcaagagagcttttttcatggttgtggtccagtttcatcaaggagcaagcattatgacattgacaatgtgtcggctccagcatgaagctctaccttcccatgaaagaggagaaaataatgctcaggaaaatcacactcgctcttgctgttgcgctcatttccgttggcgccgtagaagccaagcagatgactgaccagcagatcaaacgggccatcatcaaggagtcgatcgattcctactccggtaactgtccatgcccctacaacaccgcccgcaacggcagctcatgcgggcgccgtagcgcgtacagccggccaggtggtgaggcccccatctgctacgaaaaggatgtgacgaaggagatggtcaacgagtaccggcagcggctggccggcaacgtatagttcggtctcggaaagcaaaagccccgcggtggcggggctttttgagctaatttggctgtctgtgggccagtgagaacagaaggtcggccagatcgctgcgttcgatacttcctttagcaacgtcaaccatgatctgctcaagctctggattccgttcaacagtgaatccttgctgcttaaggtaggtcagggcggtgacaagagccgtacgtttgttggcatcagtgaaaacgtgacctctggccaggctgatggcgtacatggcagcatgatcaaaaacgtcgtcgatctcaacgtacagctttaggttctcaacccgttctagggcaccttccaatttgcccatgtcagcccggccagcaagaccgggttcatccgccaagatcagatcgtggatttcttgaacttgcccaggcgaaatggccctgttagcgatcggcaagggcctttatcactttgctgtgttcaacgatcacttttttagcggaagaaacgaccgactctgtcgacgtgcaagcagctactggcttaacagcggtacgcttcttgatgtcgatcccgtatgtgttgcgagtcacgttgtgcgctaccgtatcccgtttgctgctggactcgacgacgatgctttgtttggacttttccatgatgattccctatgaacgaacgcttgccaaatttcacgacttgcgatgagctgtccgaaatcatgcgtgtgtacgtacatgcgtatgtacgtacgtattgtatgtgctcacgaaaaaaggtggtgaaaaatcttgcgagaattttgcaagcctacaacgcatcacgcgccaagcatctcgaaagtcgagcgcgaaaaattcggcgatgacggaatgcaatagatttgaccgtttttttcgtgagcgagttcatcctagtatcgtcgaaggcacgcagaacttgatcgattgccacgtgcgtggatcggctcggtcagccgtcgtgcatgcctacggcgagatcatctccggcattgagtagttgtacttggatgcgctgctcaccgtggcctgtccgccggacgcagtagcgcgcgcgccagccggcaggccgctaaccgcgatgtggattttggcatccgagagcttggccaccgcatcctgcagcgagcgcagctggtcgatcagcatcttctgcgccggatccagagcaaccgacgatgattccgaacgagtggctgcggaagagggggctgaggcactccttggagagaccgtgccggcggcacgcgattttcctttgtagttcactccgaccgctgcagaagcatcaagcatctgtgcggagtaagggttgtggccgttctcgcggacgatcatggcgtccatcagagagcgcatcacatcggtgcttcccaggttcagtcgctgattgctatcaacccccatgcgcttggcgacggccgccacatacgctgcagtattgttttccgactttggagcccacttctgaatgatggactgaacagaggtgagcccggagttcgaatagcgtttgagttgcttggccatggcgttcagccccgcttccggtgtgtcgaaaacggcgaaccgcccgccggcgccggcttctttcaccgcgccagcctggccaacgaactgcagattgccgggattattgttgcggacaccgcggggcagcgccttggcagactgcgccttttgcggcaactccgactgggctgcctgggccagccgctggccagccgctggcgcggcctgcgccgcgtcggtccaaccggtcggcttggcctgcggattttccttgatgtaacggctcatgtactgcagcgcgttctcgtcgccaaactcgtaccagggctgataggccgccttggccttgtccttcaggtcggcaaacgccttgccgttcatgtccaggccatgccagcggctcgatgctgttccgtttcgctgctgctgcgcgcgcacgaactcgttctcgccgcggttcagctccggcgactccagcagcagccccagccccagcgacaggcggctggccaactcgccaaaaaatggcaacgtgacgcggctgagctgtttgacgccggcgctggcggcggcagccgcctctgatgcagcagcctggccggcgaccttcgccgcgccgccggccagctcctggctgacctgcttgaccacggattcgatcatccggttactgatggcggacagccccttccgcagcagccacgagccgcccaagccgacagcggcgccgccagccagcgtcgcgcctggatgctcggacagcatcttggcagcgctctccatcagcttgctgtagatcgggccgacgaaatcgcccaaccagttgctggcgcgctggtggcccagcccggcttcgcgttcgtggcgcttggcctggtcggccgctttcagctgctccggggtttgcaccgcgcccatggccttggtcttggccatgtcgtcttccagcttcttgcggccatccatcagcatgggcatcaggccctgaacgccaaactgcccggcgatcattgacttggtctgcgccgacatcttggggctgaccatcacctgcgccaggtccttcaacgctgccgacgtgtccaccgcgccgtccttggtgcggtggatgctgatgcccagccggttgagcatggccagcgccgccatgttccggccgttggcggcatcgttgagggtgctgcccagcgcgctgatgccgccatcgagctgctccgcttcgacgcccgccagcttcgcggcgccgcgcagcttctgcaattcgtccgtgccaacacccgtcatctgcgccgtgcgcagcacggaattgccatagctggcccagctggtggcggaagcggtgatgccggcgatgatggcgccgccggcaatggcggataccggggcggacaggttgctggcggtactgcccagcgcggtgccgatgccctggatttttttggccaacccgtcgaaacgctgggtgacgcgctgctccagctgggatttcgacaggtcgtcgactttcttccctagcgccagccgggtagcgaacttgcccagtcgcgcctccagcttctggacgatgggtccagcctggtcttgcgccgtgatccggatccggaattgattgtcagctgccgccattgcacatcctcagcatttgccggtgccatcgcgccagccgcgcccaggtcaggccgccggcgtcatgaggcccccaactgtaaaacttggtcacgtctgccacgatgtcctgccagtcggccggcagctggccggctggctgggtcagaaaaaattggccagatatgcctcagccgccttgaagtcgcgggcgcccaggcggccgattgcagcaactggaacgccgctgaccagggagatcaggaatttcgtggcgaagatcggcgttttcttttccagctgctcgtggaatttctccagctcgtccaccagcggctcccgcaattccagaacgtggaactgctcatcgcccagtccaacgggcttgcgcagttccagggtcagctcatcggcgacttccgttttttgggcttcgctcatcatgcttcctccacgctcatgccttcccagcgaacgtcgatctcggcctcgaccgagtcaacttccggggattccaccgtccacatgttgcggccgaccacggttttgccgttggcaagctgcagggtgacggtgacgttggtcatcgtgctcagctcggccacggtcaggttgccgctgtcgcgcagcttggccttgatgaatccaggaatcggcgtctccgaataaccgtgcacgccgtcgcggccggctttggtctcccgcttgaccttggccgggctgtaaccgaaatcgccggccaccatgtacgaggtgccattgacgctcagctggcaggtgcctgcgagcaggtaagtgttgtctactgccatgttggctcccagaaatgcaaaacgccgcccgaaggcggcgtttctgtgggtgacggcttacatcaaccggaattggttgagcagcgcgaaaatacggagctgattgaccagcgtcggcgcgaacaaaacattgacgcggccggggttgctggcatccagttcgacgatcagcgcagccttgaatgcggcgcttttctgcacgatgccggcgtgctccagctcgccatacgcggccaccaactccccgcggattgtcgacggggtgacgatgttggagcccggcgcgaatttggtgccgtctgcggccagcttcacgcgcgcgaacttgctggtgacccgggtgcgcaggaaccgcaccacataggccagggtgaacatcgtctccacctccagatagctgttgtccgcattgccgaacgcgtttttctggtaggtggtgatcaggttctcgatcgccacggtgccgtcctgcgccactgtgaaggtgctgatgccgtcgtacagcagggtgttgcgatcggtcagctggaaacggctctgcaccggcggcgccagcacgccgatcagcggcacggtctgcagcggctgggccgggtcggcgcgcacgctgacggccgtggcggcggcggtagccgcggcccacagccacgccggcgtcgggctgtcgtagaagcccatcaccgtttcgtgctggttgttgcgcgtgacaccgaaggtcgtcagcgcgcccagcgtgccgcgcagcgcggtgaacacgtggccgtaaagttgcttggcgtagctccagcggccggtctggtcgttcatgaactgctgcagcgcgttgaggctggtggtgtcgttgaacgggcagacgatgaaatcgaacggctggtcccccaggttcgccagcgctgtcgccaagctgggcgccgtcgcgccgccggacatggcggcgatctgaacacccaggccggccggcatggtttccccgccggtcgggcccaggtagttcagccgcagatcgatgtcgttgccgcacggccctttgttgaccgccgtcagcgtcaccaccgcgctgttggcggcgttggtggccagcagcgggcagccggcgtcggccgacagcacgctggcgatataggccgcgatctgcgccggttgctgcgtcggcagtaccgggatggcgtagcggatgccggccacgtacagatagaacgtccccgccgccgtcggcgcgctggcgatggtgatgctgccggcagccggcgtggcgccgggatcatcggccagcggcagataccacacctcgccgaactggtcgtttttgcgataccacgcggtcagcagcgccagcatggagttggggccgcccacggtctgggcatccgcgacgccctggctgatgacgggcacattcggcaccgttcccatcacgatggcggcggcggtcgcctggccgatgatcagcgcgcgctggctggcctgcgcggtgttggctcggctgttgtccatctctgcgtagaacagcccgacgcgcagggcctgcggaatggtcttgaagggaatggtcatttatcaccgcctttcttggccgtgtcggtggcgtccacggacacagccagcgctacctgctcaacatcgccatcgcggagccggcgcagccagtaatcggtatcgggaacctcgcggccggcggcgggcaataggtcgagcaggtcggggtcgcggatagcgaacccagccttgggtttgacatacatgggtcactcctgatgaatggagaaatcgaactcgaccggcggggcacttgccgtgccgacggtagccgacaccgcaccgtggacatcgatgagcggctgattgatagaaggctcgaacacctcggggtattcgaagtcgaatcgcagccaggcctcgcccagatgctcacgctgctggccagtcacctcgatctcggtttccaccgccagcacctgctgcaccatgcgcagcacggtgtagttggtgagtacggcgttttcgatctgatcgcagagggtgtccagcagcgactcggcctcaccggcgctggcgccaaccaccctggcattgaccgctaccgtagctgtggttaagaactggggagcgcccagcgggccacggccctgcttgcgctccattggggtctgcaccaggatcagcggcatgccgggaggtgtggtggggaggtcgcgcggcacatagaccttctggccggccagcgtgttggccgcctgcagcgccgccaccaccgcgcttcggagttgggtgcggaacagcatgtcaacctccggacacgtagttgagcatcagcttgatggcgccgtggccgtcagggtgaacatccgccaccgagtagacgatgcccgtccgcaggatggcgactacgtcgcctgactgcggcgggaacggcagcgcggccgcccggatacccagcaccggctgggaggtggaggtgtagatcgacccgcccaatccgtcgacagcgcggtatgcctcgtcgaacacgccggagatggaaatcgactggccggtggtcgtggtgtacgtcaccggctcgccaaacaccccctccagcggcgcgaggactgcggcgtcccagtcgatcacggtcaggactccgcgcggccggacatcaacacctcgggacgggtgcagatgaacagcgggtaggagtaggtctccatcttccaccacatgcggcgcacggtatcgaagatcggcagtacgtacaccggcttgcccggggtgttgacccagtctacggtttcgccaggcgcgttggcttcgcggaagatgccaggggcgccaaccgggaagaacttgaccttgtcgtccgggattttgatcgtggcgttgtcatccgagccgcggtagttccaccagcggatgccgccgaactcgaaggagtcgaaggcacccccttgaccgttattccgcaactcggccgcatcgctccagttcaggaaggtgcggatcacgtccgggtgattggaaaacaggtcgtagaaaccgtcgccacacaacgcatggacgcgggtgctggaggtgaacgagccttgcgcagcgcgcgccatcgcgcgagtgatgccattgcagatcgggcgcaaggtgttggcgacgccggcggcgagattgaaccccacctccggcgcctgcttgattccgaattcgtcgaaccagttgtacagcacgctgccatcaccgggattcagacacagaccttgcacggcggccagccgcaggtattccttggtgtactccaccgaagccagcaggccagtggggccggaaaggcggcgctccacctcttccatcacctgcatcagcacggattcctggccgaattcgcgaatgccttgcagctcctcggcgtagacggtgtcgtcatgcatcagccgcggcacgtcgaagtatcgcattttgcgcttctcggtggtgcgctgggtgccttctccgccgcgctcgctgaacgggatcagcaccagcttgccttgccgctcctcaaccgccagcgctttggtgcggatcgggttggggtcgaaaatgttgagctcacccagaccgttcggttggtacgggttgcgctggactgcatcggtcagcgtgatggccgagaacgcatcctgatgaaagatgtcgaggatattggcgggcatggatcagcctttcgggaataaaaaaaccgcccggaggcggtttttctggatgggtgctggcggtatcagcggacgaggatgtggggttgcgccagttgggaaatggcgaccgcctgctgcgcgggcgtgatgccaggcggccacagcagttcggaaccattcacctccgccaggcgggtgaccgccagcgccggcttcggcccggtggtcacgtctttggaggcgaaaagcacaccggcggccacttgcgaaccatccgtcgccgccggattcagcgggcgccactggccagcagtgcccggcgacgtgacggtgatggtgaacgaatcaccaaccgcgaacggcgtgctgccggccgctacagtgaacaccatgccatcggcgtccagcgcggtgccgacaggcaggtccacgttgttgaaattgcccggcccggtgatgctgaacacagtcggcgccgtcagcgtgatggtgaacaggcccgccggggtgaaaccagcttgcggctgcgtgccgatggtgagcgtgccgttgccgacgttggctgcgccagccgcagcgctggcgaccggcgcggcattgctggccgaaatctgacccaagacggtgccggccaggaccatttggccaccagtcagcaggatctggtcgcgcgattgatgcccggaggcttcggaaaccaggaagccaccgttatgccaccactcttgcagcggggcgacagtagggttacccatatatcagtcctcttgatcggaataggttatcgacgggccttggcgaagaccttgtcccacgcgctggcctgctgagctttgccgctgggcggcacgccatcggtagcacccaactgcgggttacgcgcggcgcgaccggcgttgccagccggagcgccagccggcgtatcgcgcaacaccgccagcgcttcgctgcgcgtcatcgagctgttgaatgccaggttggcggccaacaccgggttgcgggcggccgccttgctgccgaagatggcggcgcagcgagcgcgttcgcgccggcgggcacgggcgcaggcgctcttgccgtgcatttcgtcctcgtcgtcctcggcgtccggatcgttgtcgcggtcctcgtcctcgtccgcatccggctcttcggcacgcttggccttcttgccgcgcttgcctttgccgccatcgcggtcatcgtcgtccggatcgtcgccctcggcgcgacggctgcgcttgccgtcgtcgtcatcgtcgtccggatcatcgccttcggcgcgccgactgtttttgcggtcatcatcgtccagatcatcgtcctcggcgcggcggctgcgcttgccgtcgtcgtcatcgtcctggccggaatcggcgcgactgccgcgggagccggacacgccggcgagatgggcaaaagacagcttgcccgacaggctgctaagaaaagacatggatatctccagagggttagcccagcttggccagcagggaacggaatgcggcatccggcgccatcacggcgtcagcaaagccgattttgacgccggcggcccccatgaaggtgccagcctgggtgctgcgaacagcgcgggcagaaatgccccggttgcgggcgacggtgtcgacgaacagctcgcccatctcatccacatcagcctggaaatcagccagcgcctcggaggagagtggccgcacatcgctgccgttcgccttcttgtcgccgtagtggatgatggtgacgttgacgccggcggcgccgagcgccttggacatgtcgacgtgcatgcagatcacgcccacgctgccggtgccgccagtgcgcggcacgatgatgcgatcggtagcgctggccagcgcgtaggcggcgctgtaggcgttttccgtcaggatggaccagatcggcttctcgccacgcgcggcgtagatggcgtcggccagatcgaaacagcccgccacttcaccgcccggcgaatcgatgtcgaacacgatgccatgcaccgagtcatccgccagcgccaggctgaggttggcgcggatgccgtcatagcccgtcatgccggaatacggctgcatggtgcccagtttctgcaccagcgtgccgctgaccgggatgacggccacgccggcgaccacctgatatggtttggtctcagccggcgcgccgacatcaccatcccagtcgtccagcgctaccacgcggccattcgcatggaacagacgcgccaagccgaagcgatcggccagcgccgccatcaccacctccgctttttgcggggtgatggccagcggcacgttgaacagccgctgagccagatgtgggtagttgatcattgcggggttgggctttcttcaggggttgaggcctcggtggccggggctccataccaatcaggcagtttcaggccggcttccttgaatttccgaacttccagcgcgcgctgatcgatggcttcctcatagtcgaggccttgctccgcgcactcgcgcttcagcgttgataggccggcgtccatcttcaagacggacccctgaggctccttgaccggatccacccagcctcggccgacgctgagccattcgcaccgcgcatattgcgtccggaattcaaggaaatccggcgcattgcgcggcagcggcaggtcaccgttgtccatcgcctcatgcagccaggtggcgtacatgggcgaggccgtgccgatcttgaattcggcgcggcgccgctccagcgttttccagctctccagcagcgcggcgcgcgctgacgagtagttggtgcgggaccagtcctgcgtgatctgctccgccgaaatgccggaggcggcggcgaacgtcagttgcatggcgcggacgaactcgccgaatccactatgcggatgggcggcggccacggtctcgatggattcgcccggcgccagcgtcgggatgcgcgcgccgttgagcatgaccggccgcgcctcatggaaatcggcccgaaggtcctggtatgccgacagctcatcactaccattgatcgcctcctccacctgagcggaatcgaacgggctggtgatgtaggtgccgaacgaagaggcgatggtggcggcctgtagctccacgccgtagtagcgcgccagcatcttgaaccggctgagcaccgacgtgaaaatgccgatgccgcggttctgcccggcacgatcccgctcgaaatcgtggatgacgcgcacccagccgtcgtcatcctcgcgttctatccgctcccactcgttggactcgatcgcgttgtaccagtcgttctggtgggctttgcggatgtggtaggcgatgggcacgccgtcgtcgtcgatttccaccccattgcgcaggtatttggtgtccaccatctgccacgggttggacagcctgtccgggtccaccaccaagtaacaggttgcatagcgagcggcgccgggatagaccctgtccggcttccagtagttgacgatcaagctgtcgccgtctaccagcttgtgccgcagccccaggcgaagctgctgcgacaccgtcaactggcgcgacaagtcgttgtagcggccgatgtcgtcggcaaaccctcgccacaacgcttccaccacctgctggaattcgttggcccataccgcgtcgaattccctgatacccgtcatcgtggccagcgcgcggtaatccggcatcgacgacaggcgcatcgacacgccgacggtgttgtccagaatgcgggtgaccgcgccctgggccagaccatcgttgcgcaccagatcgcggctgcgtgccaccatccggtcgcggaactggttgatttccgcatccggcgagcggataaacggcagccagtcgcccatttcctgcgtcgaccagctggaggcgtcatacggaaacaccgatgaaccagccagcggaaggccttccgttctgaccgttgagtcgccgaacgaagcgcgcgccggcggcagcgggcggccatccgaccccagcaaagtgatttggttttccatcagaacaccggtcggattggcctgcgcctcctcatccccagcgcgtacatcaacgagttgatgtgctgctgcagctgggccaggttggcgcgggtataggttacggatttggtgccgtcgccctgcgtgtacgagtacgactcacccaggccgccggtactcagccggtggagcgccagctgcgcctccgtcagccattgctgcagcgtggcctgcgggatgccggtgaagttgttggtttgcggcgtgaacacgacgtgggctcctatgccatgcgacggacgagagagcgcttggcggccggcagcttcgcctcttcgggcaaagcatttgaatgggctgcctgctcaactttcaccgcggttgatgtcgaaagttggtttaatttcaatccgaagtgcagcaagccacacagcgcgccataggcgtagactcggcaatcgctcgcctcgttggccttgccggatggttgctcccatacccggtagcggacgccgccggtttctttcaccacaattcgctctgctgttatctgggcgaaatagttgatgtctcggtcggtagggaagtgcatgtagccagggcccggcacctccaggtgcagtcgatttctgatggtgtccttggcggcattcacgcccaagataatgggacggaaagtcgctttggttcgcgatcgcggtcgtttagtcggccagacggggtttcgttgcccactccgtgccgactctcccttgatggcccaaacttttcgcccgaggcgggctttggcgaattcgtacactgcctgggtatggtggccgcccgagtcgatacacgcggccattgcactaaagccacgaccatcgtcccgccgccatatccgcttcaggtactcgtccagttgtttctgagtttcgggctcgctcatttccccatcgatcacgtggtagtcgatggaccaggactcttcattgcgcccccagcctacgacctccatctccaaccgatagtcctgtacgtcaatgccaacggtaagaacagcaacgccgtccggcacttcgcctggccaaacctcgcagcgcgctaccagcgactccaggcgcagttccttgccagagtgtgggcggtgcggcaatcccatctgggtgttccaccatgcctgctctttgtcggcgtcgccttttgccgccaagtacttcctggcgatatcggccggcttgtccttttgccaggggctgaagagtttgctggcctggtatcccgcatgtgagttgtcgactccccattcaccacattccgggcacttggcgcggtataccgcgtgccgttcaccatcccaccagtcccagactgctgcgactgagtctccgccggcctgcttcgcctgttcatacaagtccagaggagagtgccgatgcccgcagcagtcaaagggccttgtctgatgccaccgggtggtgcgtagcgcgcgcaggcgctcaccctcagaccagcctgatccgcagcagtcgcagtagattcgcgcagtctttggatcgtgccgaccgtcaggcttgtcccagttgacgtgcttgaaaaagtccaggaatacgcgctcgccgcaatgcgggcactcaaccgaagcccgccgttgatcggactctccatagctgtcggcgatccggctttcatcctccagagtgggggagcaggctcgaactgaaagccagttgacaccgaatgtcgcagtccgttcttcagccagcgtgattgggtcgccctcgcgcgtgaccgggtatttgtcgacctcgtcggacagcagaacgcgaatggggcgccgagccaggttgtcaggactaccggcgccggccagcgccaagaatccgccagggaatgacttatacagcagggtctcgtctgcatttcttgtcttgctggagccgatcagatcgcgcagcgccggcgtaacacggatcagcggggagatccgctccttggagaactgctcagcggcttcatccttaggctgcagcagcaagatggggcaggggtccaagtgcgcgaaatagccgaacacattctcgatcagcgccgttttcatcaattgggtacagcacatcgtggtgatgatgtgcacgccgggctctgtgactgcgagcatcgggccgcgggcaacttcgaccgtagcggtctcccagttgccggaagtgctgccggcctcccgcgccagtttgcggtatctgtcagcccaggtcggcacgctgatgcgaggaggcggcgtccacccgcgaacaaaggacgcgcggagtaactcagccttggccgaagtccccctcagggtcaccgagctgttgaatgtgcttgtgcgcatgctcggtcagtacctcagttacacgatcggcctcgagtccgaggtcggcggcaaccaaggggccgacgcgcgccggccagttcagccaggcatcgcgcgccgcccgggcacactcaaaaagcacccccttggccacttctatttcaatcagctgcccggacttctgctcgtattccaactggcggagcagggcgagatagttttccttgatacgcaacgcctcggcatagtcgcgatccggcaccgcgccgccggcaatcatgctgcgggcggtttcctcaagggactggtgtacgttgccatccgatgcgaactgcgaactgcgaacaccctgcgaactgttcgcacttgtgttcgcagtgttcgcaccctttgcgttggcctcgcgccatgctgtgcccaccagtcccgcatctatcttccccccgtccgaaagcaccagcctgccttgttttacggcacggcgtaccagtgtgtcggagcaattttctcgtcgcgcaaactctctcagcgaaatcagttcagacatgggtgcgaacacctttcaggacctatagctgggggagaatcgcggtgcgcaatgcccgtggaactccacccctacggaaggacccgcccggggcctaccgagccgacgccagggccctggccagcgcgtgccccatctcgcggttgaagtgcctgttgacctgggcgatggccagttcgtggtagcccagatggatgtccaccggcagcgcatcgccgaatcggatcagcagtttcaggtgaccgcgcttgtcatccatcacttcgttcagaccgcgcagcttcttgcgtttgccgttaagtagcgtcacgcgccggggatcaactggtcgctgccacacgccatcgacgatgccgcgcctagtcttgaccttgccaatgaaaatgtctggtctggctcttagtcgcgccaaggtgccccgtgacagctggccgtaagcgttcttcttgatgtccttcgggttcagtagcgctttgctgttcagcacgtgttcgccgccggactcatacggtgccagatatcgagcggcttggtccttgataaaaaccatcgcctcttgattgctctttcgcgccgcgcgcactccgacactattgcgggtaaatggagtggggttcttgaacttgctggcgatctgtttggattcggcggcctgaacggtcttggcaactacggtcaaggcctgtgctgtagcgaatggcagctggtcgcgctgcatcaacgtcagtttcctgcgcaaagctttggcattcgaacttacggagatgaaaggggtaggcatgtttgttctgagtgccgtaagagctgtcccgtcggacggggttgggtagggcggcggactgctacgctctggctaaacaacctggagccgatatggacctgctcgatgttacgccattcgttctgtcattcattcgcctgggcgcgctgctgctgattgcctgcgcggtcggcgccttcgcggcgttctacgtcgaccaccgcatggcgctgatggagtacccgatgcacatgcgcaagcgctaccgcaccctggcgttcgagttcagcacgctggccgttgtggtgctgggctcgctggagacgttcctgggctgatctacacccggaccatctccggcacgcggtggcgggggatgatgatgtagtcttccttgctcagccgctcgaagtaatcgaagcggatggtagtaggtccgatttctcctactctggcggcgcgcccggaggccatcagcacatgctggccttcgcgcaggtggcaggcgtcgaggacggcgcgggcgtgttccatgtgcatggtgggctccggaaacgacaaagccccgcgcagtggcggggccggaaatggaaacagcccgaactctggacgtagttcgggctgctgcaaaaatggtagttctgtaacatccggcatgtcaagcgctacgtaaaaaccacagtccggtgattctctgcaaaaccggcttgctatgccattttgattgatatattattcaaacatagcaggacgaaacagcaaccaaccggagaaaagagatgtctgccaaccacacctacgaacaaatcgcctccgacttccaactgtggggagagtactttgacaccgctgctgaaatgaccgaagaagagttcaatgcaatgagcaccgaagacaaggtggctctgcaagttcaagcgtttggccccgagaatgaatgagcagaaagacaaccgcggcggcgctcgcaagggtgccggccgcaaggccgaggatggagcgatcggccttgtcccccattccatcgcgatgacgccagatgacaaaaagtggtgtcaggacgtgggcgccgcccgcgtccgcgccatcattcgcgctgcacgagaggcagaggctgggctcgatggggaataacagcggctggaactggcatgcccacctgccaccccccaccccagagagtgccgccgcgttcgggcagatggaattcctcgacggcctgcgggtctggtttatgcaccgcaccggcgcgccgctgaccaatgcccagctggccgaggtggccatggtgtcgcagaacaccgccgagtcatggcggacagcacccggcctcgccacccaccgcgcgctcagtacgcgggatagagtactgatcctgctgcgcctcgcgaacctcgccggcagccgccgaccaggcaatgcgcgattggcgcggtggtccctggctgaggaccagatcatttgcgcccactatgcagtggtgggcgccgtcggcctggtatcccaattgccaggacgctctgctgaggcaatatcgattcgcgcgggccggctaggtgttgctgggcgagactgctcggccctgtagcggcgtcatcaggccgtcctccgctccacatagcacagcctatccagcacctccgccatcggcccttccagcgccgcataagcctgattcatcatgcgctccagctgagccacgacgcctttaccgtagcggtgcagcgtcatgtggctgaggccgtgccggtcgcccagatcgcggcagcctggcccctcaccggtggcccacgtgcggatgatgtccaggtcggtcttgtagccgtacttgcccggggtgtgcgtggtcaggtagaccatctcggtctcgcgctggacgtgcagtgcccacagcacggcgcgctgctcgaacggcagccggctgatcttggccatgaccatcgccgactgcgccttgaggtcgtggggtgacaggccatcaaacgccggcgccacggcctcgccgaatttttgcaccttgaccatgctggtggtctcgatctgaaacgcccagcccaccagcgcgcgaaccgtggaaaactgcatatcaccccccctgtttcgttgaatcttctgctcaggccgcgaacagcgcgccctggatttcctggacctgcactgtcactcccggcgtggcgccgtaccgcttgcgcaccacgatgtcgcaggcctggacgtcatccacccacaccacgccgttcatgccgtcaaacagcgccttgaccacgttgtcggcgtccggctttttggtcgggtatacctggttggtgagggccgctgcctgtttccgtttgctccagctggtcgggatcggcagcaccatgtggatggtgacgtccgcgggtccggtcagcggtgcgcggccggccatggctgcctgggcggcgagggcgatcatcccctcatagctggcggttttctcgggggtgtacatgcgcgcgaatttgccgccgcgcgtagacactttcggccggcctttgccgacaggcgtaccgggtacggtgaagcggatcgcggtcatttcttgattttcctctggcagttcctgcagcgatcggcgccctgggcctggatcagaccgactccattcgtctccacggcaccgaggccgcacgcgctttgaatcacgccgccatcgaggcgagtccagtggtgggccaggcagtgccggccgacgaacggcatgtgtgcccaggccgatttagtttcagccggtatgcggccaatccaaacgccatgtttcattgcgcccccagcttcagctggatcaaagccagcagccacagcggggaggtcgccagcagagcggcgacgagtagcgcgccggcgatggcgcggcgccaggtcgagatgcgtttcatgctgcgtcctccatggggtttgttttcggcaggtaggcttgcagggcctcggggacggggcggccggctttggccagggcctcggccgcgtagcgcttgccgatcgtcccgcccttgtacacgccgcgggctacctcatcggcgatcttgagccagttgtccatgcgctggccgtggccgctggggaactgcatgcccttggccgcctggtgcacctgggcgatgtgaacctcggcttcttcgcggctcatcgttggcgccggcagagcgtcgtagctgtcgctggccggcggggcgtaatcgcgggagcagcaggcctggacgaactcgtcggcgctgggcgggtagcggaatttgctctccagcccgtggcggatgtcggccggagacaggttgcgcagctcatggacccacacgtcgatggcttccagcagcccgatgtccatgccctcgtacggcagcccctggtccttcgggacgcgctcgccggagcggaatttgtccacgaacgcattgccgaagcggccgcgtaggctgcggaaaatgtcgttcacgacatcgcggtcaacttgcgagtgctgcatgcttgcctccggtcaggtattgctggccgacgccgatggtgtccatggcggcggcgcgttggtcgtggatggtgttgccggacttctgcgcggcctggaccttggcgtccgtcacgcggttgcggtctgcgttgaactggcgctggtccagcagccacttgcggtactgggcttgccaggcagtgtcatctgcgcgcagggagcgggcggcctggtggtgggcgatgaatcgctccatctcggcgtcagggtcaagctggagctcgccggcctttaggcggctggttctgtcgggttgcaggtctgcagggacggggattccggaggaggtgtcacgcgtgcgctcacccaccgaacgtagtgaggtgggtttattcttgtctttatctttatctagcgtgacatcgcgtgactcgtcgtgacattgacgtgacatgtcggcgtcacgcgcttctctctcacgctgtcgttgctctcttttccgctctgtagctgactttgcgccggattcgtcactgccttggtcctcgcgctttggctggcgcttgtcccagccagacagctccaggccatccagtacccggccttgcatggcagccaaaacggcctcgatgtcttcgtctgtcacgtcgagtgcgctggcgaggtcttccgccgtgactgtcacgtgacctcgcgtgacattgcgtgacgcatcaacgagcaggtgcagatagacggcttgcaccagggcgatgggttgtccggagatacgcgcgatcgtccgccacttggggtcattcggcatgtcgtgccagagtctgagccattggttgctcatggctgctgctccgcgtcttgcgaggttcgagttgcactcctggcggaccggacacacagctggccaattagcgcagcaacaaaagcctccttgtttgcggcacgaaggtattgctgcatcaatagtgcctgagcgcggtcgggccagttcttgatatgattcgagatcacctcgtcatactgaacaatcatttccagattggagttatgcatggctgttctccttcacgactgcccgcactgtctcggtaagtctcttggttttgttgcagtggggtcgagcctgcaccaagtgcgccaagggtggtggaacatctttttccaatgcccatcgtgctctgggccaatttgcgcgattgctgaatgggtgcactcgattaaccccaaagacttccctgggaaccttcgtagtcgagaggccgcctccttcttgcgtgcgataaaggtattctcggaagtcggtattttggagattccagagcatctgcctggcaacgttgcaagggcatttgaagagtctgcaagcgctcgcaagacgagcttgcactcggttgcctgtgcggggtatcgccgtacgatggaattggctttgaaggcatttgcgccagaaatagaggcgtggacgctggaaaagagaatcgataagctggcctctgaaaataaaatcactccagccttgcaagagtgggcgcaccagcttcggcttgacggtaatgaggccatccatggggatggagaggctgatgaggctttgtgcgatcagatgcatgaactcacccggtttttgctcacatacctctacacaatgcccaagcaagtcgagttggctcgacagcaagagcacgacgggggagcaaaggcggctacctgatggcggtaggcctaaggtcacatctgaagggttgatctgttcgctgtgcttgtgcatacttgtcctcgcaagtcctccgaacaacccccgcgagccgcgccaacggcgatgaccgggggttttgttttttcccgcgacgccgcgggcggcttactacacctgtttcagccggcgccggccggccactgtctcaatcgttgccggcttcagcttccgcgcgccgggcagcgtgtacgccatcagcttggcctgggtgtctccaggccggaaaaccactagcaccgcatcgaacggagccttctgtgctgcgcccacgaattgcaggcgagggcggaggcaccgcacttcagcagccagaaacacgttccgatgccaccaaagaaccgacgtccgggccgggaccaggcaaacgacggtggcgccctgtaggctgctgagcctggccttgtccatccagtgcttggtgacatgcccgaatgggggattcatccagacggtttcattgctccagtcctgcgccaggccgttctcggccggcgtgtagaagcgcgcgcatttggccgtcttctccgtcgcgcacacgtccaccgtgaagccgaattcggcattgagggcggcaaacaggtctgccggcgtctcccagtcgtcacggtcactgcggaagtggatggcggcgtcagtcatcggtcaactgggccaggtcggccaggaatgactgcagcttgttgatcttccggcgcagggcggcaccagcgtgccccttcaactgggccaagccgcggcgcttctccgcctcgccgtcgtgtcccttgaggctgtccgagatcatctgcatcaggccgcggtcggcggagtcgatctcctcaggcaccgaggtcagcatgtagccgaactcatctgccagggcctccagcatcctgtgatcgttggtcaggctcatcagctcgaccatctcctgcatgtcgaaccatctggagttgtcatccgggttggctttggcccggatcacgccggcatagccgcccatgcgctcggcgatgacctttgagccgcccgcgctgtgcacggtcttgtgtgccgcgtcccgccagttcatgggcatgggagtcctttttgatcattttttcgggggaaggggtttgccatacttcactcaggccgcgaaccaggggactttgcccagtcttccttgtccatgcggtcaagctctgggaaacgcctgatcagctgatacgcacttccgtcaggcactagctctccccacttggcaactgccgctgtggagaccccgagcgatttagcgattcgggacttgaccccacggccatccccgaagtacgtcacaacgatagctgttctcatgctgggaatgataaccatggtttacatcaagtgcaatcctgagtttgcgaaaattccgctaaccttggttgacatggaaaacactcttggaacccggatacgcaaggcccttgaggctttgagcgtgcaaaccggaagcaaaaaaacacccaactggctggcgatccaggtgggcgtgtcacgccctgcggcgtacaagtggatgaacaatccgaatgcggggattgagggtgaaaacctctacaaagtggcccgcgcattgaatgtcagcgcagagtggcttgcgtttgggcggggcgagatgcagccgtctgcaggtgggtacgtggaagccagttccgttgaagaactgataagacagatcaaggccaaaggcccggatgcggtgcttgaggtgatcaagggcttggcagataacagcgacaagttcaccaactaaaaaggcgacttctcagtcgcctttttatctcgtccgtttcaaatcttgccatccctggcaaatacttccttcagcgcatgcagcaatgatcgcacctcaccaaaatggatgagtttcagcttgccatgctcatcgatttcaaggcttaggaacgcccgccgggggcctctggccgcatcatcgggcctgtagtggtggcaattttcggtgtgaatgcaaggttctgcggtactgctgctgcaactcataacctactccgtttcgtgtggcgagcgtttgtccggcgccggcatgggcgtcatgtcgttgtctgtaaattttcccactgactagacaaacggtcacttccgaatcggaagtaaaacgatgtatgcgtatttctacgtagttttcaatcaattgattgaaatagaatgagcaaaattcatgctactcacaggcaccaaatctgtacatgagttgctccacagtccgcgccccgtaaagggtcatcagctgttttaagtgatagtcgaccccacgattagtcatgcctagggcggctgcgacctcggtttttttaagcccttggttacagatcaggtctatcagaatttgctgatttttttccaatttggaagtagcccgctggccggccaaaactcggtaggcgacgtcggtgacatcggggcatagcagctcgagggtgtggcgcagctccagatcctgctccacgtgcttgccgatcatcgacaggacgatgcggcaatcgttgtattcggcgacgtaggacatgccgtagtccatgccgaatcggctgcaatcgcgcaagtacgcccggaatttctcgtttggactgaccttgccgatcaggtggtgcgaccagggcaccgccacgccgggtagggcggaggcgatggggtcgacctcgtgataggcccgcgcggcataccggctgagccacccctcactccagccgaggttcatggtggtggacggctgcaggccgctgtccgcgcaaaacgctaccaggatggtgggcgcgtccgagatgaccttgatcatcgccagcgcggcgtgcagatcctgttgcgtgcgaaccttgagcagcatgcgccgcataacggccgtcaggtagacggcggagccgggcttggtctggaacagctccaggacctccggcagattgctgatggatttagtcattatggcctccccgatagttcaggttaggccatttcagggcgcagcaatatcctgcgctaatgattttttagcgtttggtggttaatagcagctggattagctgccaaacctcatcaggccctttgtccagcagcttctctgccaaatcctcaagggagctggcggcgacatacggcgcgcttgctgtaggctccgggcggcgcgatcctttgccgtcttcaatgtattgcggggtcaggttcagcgctttggcgaggtccaggatgtgcgttgtgccctgtacgttgtcattttccaagtcggaaatcgttccgcggctgacgccgaccttgcgcgccagggtggtctgcgaccactttcgcgccattctttcctctcggattcgtgcacctctaccgttcattgcagcatcatcggccatcgggatgccagtatggcttcgggttgtgccggtaaacttgcaggtagcgcccatgaaaaagcccgcgctaggcgggctggggcgccaggtgtttttatccgaaccgtggtgggtcaggcctgacgttgggagtagtgtggccgccggccggcggcggggtcaagtaagggaaaacccgccaaactggttgggctgccgcctagcttacgttcttggcaatgaagtagacagcggtgactaatgccgatccgaagccgcagacgaaggtaaccaacttccaagtctgggcgttgatctccttgtgaaggtcgaccctcagcaggtgtaagtcgtccttggtggccatcgtattttcaatgacggtcaagtgcgtctcaacccccgctaggcggtcacgggtggtttctgcgatggcttctaacttcgatacgcgagcttccatgtctccattatggggtgggccgcccccgtcttcaaggggacgcgtttttttcgagtcgaagggaacgattttcctctcagccattgtggtctaccacgtcatcgaacgcttcaatgtagccgcacgtggagcatcggtataagcggaccgtgaagacgcctcccgagacggaggttgtgattgccgggttaccttgcggatggcccgctgcagtttctgtaaggaaaacgcccatatagccccacgcgtgatgcgcggggatccgctccatctcttctagctgtccatggccgtaacggcactcaggtgtaataaccatctctccctttctggcatagcctgctgaattgactttgtcattttcctgctgcttttggtgctgcagtagctgctcagctccccacccaccagaacgcccactcgcccagcaccagcagcatcgtcaccagccggcagccggccgggtccagcgccgcggcgtcgccggcgtagtagagcggattgttggcggcggtcacctggggatcactacctcggcatagcaccggcaatctccctccatgcttgcagtgggtactggtcagtaggactcctgccttcttacttcgcgccagaagcctccccgccacggctggcggactgctgcatgtcccgaatcaagctgttaaacgctaggccattggggattacatagagcggccccttctcttcggcaggatatatcccgaatgtaaaggggaaaggaccaccttttagcaccaatccatcatcccgggtgagcgttgaggttgcatccgccccgcattgaagcaccccgatagagtttcgatcggcggccatgaatgctcccaactcaattttcaaagctttgcggagctgttgctcatcaagccttccggtctgatcttcgcttttaatttgcttgattactccatctgcaaccaattttttgaggacggtctttgcttcttcagaccagcactcctcaatcttcggtttctcagcgcagccggccagcgccagcgcggccgccacgatcaccattgttgtcctcattcccgccgctcctacagactatctggtgcgccaatgccgataacatcacacagcaccggggtgagatggtggccagttgcagcatggaatagggtgcactccactcgaaccctcttgcctttcaactgcttgaatgcactccactgagccttgtccttcagaaccagctgcatcacccgaactccttgctccggaacttcatcagggtctggattctgtgcatttgctgacgatgcgttgatcggctgatcgagttgtagtgcagggaacgtcacggttttttctttaccgtttgtgcagcagtcaacccccttcctttccaccagcgttcccgcaagtcccaccattttgtcgtactggacatcaagagccatggcaggtgtagctgacagggcaaggatggctatcaccaagcttttgttcatttttatcatcgccaagttttgacgttgtcattttacagcactggaggtgttgcataaatgcaaaccaaagttagtcaaatattgaaaccatggttgacgttaatggaaaccatggtttacatttcgctcacaccaccggcacgccggaacgatcttgaacaaaccgcagtagcagacggcacaccgcccaccgtgaccacctggcagcaaccagtggcgaagagggcggatagcgccggcacatgatcggatgcaaccagcggcgtcaggcggggatagaaacctgcagggcgagcgggaagcggcaaggccgcaagatgcagatgaagggagtggagtcgggtggtgtagatgggctggcgaccacggccaggcgaccgagcaaaggaagcgaacgggtggaggtgagccgtagcccacggaaaggcgcagtttgatgccagctaccgcaccctattgaattcggcccaatggcacgggcggcgaagggcaacgaggcggtcgcatgccaagcgacgccggacacgtaaccggcaagccgcttctcacgaggcggcacattgaagcggcggcgtggaaggacacgcagggtaggtagccgcggacccgcaccgatcacgcgcgactgtcgaatgggtgcagccggtatcaagcccggcccgcttcagtgtgagcagcaaacaggcacgcggcgggcctgcaccgaatcgctgatacaccgggccgccgtgtgcggcccatccctgagcatcttgcccgcagggtgctcagggatgcacccgcatccttctcctcgtactaccccgtttgcccggcccccccgcgccgggcttctttttgcccaatcccggaggtcaacatgatcgcccacgctagcgcggcgccggccgccgcacagattaccgtccacacctgccagctgcaggcggccaactccgccagctacgcgacacgccggctgtcgggttatcgcgtcgattaccagcaaccgcgcacccggcggcgcgccggcctgatcgttctggcccgcagcatgggcgaggcgctggaccgtgttgacggcctgatgcccggctacgtcatgtcgggatgggggagggcgcggaagtgaaagccttcatcaagaacacgctgggcggcctgctgatggtcgcccttttcttttctgcgctgacgctggcgcaaattgcggagcaactgaaatgagcctgcaaaacctttcctgcgcggtgctgaatgacctgtgccgccacctctccagcgctgaccgagatgagcggctggtgctggccgtcgagcatgaggccgatctgatgctctccgacatcgaatgcagccgcggcatgggcgagtcgttcatggacatgctgctgagcggcgcgccggcggagctgatgggcgagctgcatctgtacctgggccagcagctgctgcgccgggtgtttgacaggacggacctgggcccgcactacgaccagttggcgcgcgcggcgcgggcgtttgtggatgcgtcggcggcggcaacgctggatcggcgggttgagagcgacgacccggaagaggatgagagggaggcggcgtgatggcgcacaagggagcaagagagcaagcggtggaagcgcttcaagattgcattcgttatggcagcctgcctcggcaagttcgtcataagacggagcaggcagtgtccaggctggagcaaagcatcatccacgcccgcaataccgcagaacagcgcgaccagctgctggcggcactggagcgcgcagtggccgaggccgtggcggacgatctggacgactggttcgccaatgccaaggccgccatcgccgctgtgaaagggccggcagcatgagcgccaccacaaccctgtccagcatcctctacgcgcagcgccggctctccaacgagatcgagctgttcggctcgctgccgcgcacgcagcaacagctgacccctgaacagaaacgacggcgtgatgacgcctggcagcgccgaatggcgcgcgagctggcaggggaagacccgataaacgacaaggccgcctgagcggccttttttcatggagcaaccaccatgaccgccacatcccgcgaggaatggctcgcgctgcgcaataccggcatcggcggcagcgacgccggcaccgtgctgaacgtgaacccgtataagaccccgctgcagctctatctggagaagcgcggcgagatcgagccggacgacatcagcgagaaggaagccgtccacttcggcaacgtgctggaagacatcgtcgcgcaggagtacagccggcgcaccggccgccgcgtcgagcgctgcaccaccacgctgcgccaccccaagcacccgttcatgctgggtaatctggaccgcctggtctgggagggcgacaagcgcccgcagcaccgcggcgagatccgcacccgccacctgctggagtgcaaaaccgcgctgggccggttcatcgacaaatcggcatgggggccggacggctccgacgaagtgccgatgacctatatggcgcagtgccagcactacctggcagtcaccgacgccgagcagatcgacctggccgtcctgctgtccgggcctgagttccgcatctacccgatcaagcgcgacgacgagctgatcaccgcaatgatcgagcaggagggcgagttttgggagcgcgtgcagagcggcagtgcgccggagatggactacgaccacgacaccacaccggacctgctggccaagctctaccccggcaccgacggcagcgagatcgtgctgccggatagcgcgctgcactggcagcaggtgctggccgaggcgaaagagcaggtcaagctgtacgacagcatcgccaccggcgccaagaaccacctgctgcacctgatgggcaatgccgctatcggcaagctgccggacggttcgcagttcacccgcaaggcgatcacccgcggtgcgtacaccgttgaccccgttacctatatcgatttccgattcaagaaagccaaggaggccgcatgagcgccattatcgaacacgaaagcattaccgacgtgccggcctaccatggccaccagacgtcgaccaccgcgctggtgctggacgacggcagcatcgaccgcatgatgcgcctggcggagattatggccagtggcaaggcaacgattcctcagcatctccggaacaactccggggactgcttggcagtcgtgatgcagtccatgcagtggcggatgaacccgttcgccgtggcgcagaagacccacctcgtcaatggcacgctgggctacgaggcccaactggtggccgccgtgatcaataccagcggcgtgactacggggcgattccactttgagtggttcggcgattggaccaaggtgatcggcaagttcgatatccgcaagggggacaagggtgagtatcgcgtgcctggttggaagctcgcggacgaggaaggcctgggtgtacgagtttgggcaacgttgaagggtgaaactgaaccgcgggttctggagctgctgctcgcgcaggctcgaactcgcaattccaccctgtgggccgatgatccgaagcagcagctggcctatctgtcgcagaagcgctggtcgaggctctatgcctcggacgtgctgctgggcgtctacacgcctgatgagctggaagtcgttgcgccagaggagcgcgacattacgccgcgtgccaacagcgcgccggctgctgcggcgtcttcctcccgcgccagccagctcaagcagaagctcggcgcgaagccggtgccgaccgcgctgccggggccgagcctggacgatgttctgcgggctatcagcacagctggcggcaaggctcagatgcaggcagcgaaggagctggcgagcaagctgggcgagcaggaatacgcagtcgccgcggagcactaccagttgcgcgttgaagaactccgcgcgcaagcggcggcgcaggtgcctgcaggccaggcttcaggattcgacctcaccggcttcaagacccgcatcgccaactgcaaggacgtggacacgctggaccttctggccgacgaattcagcagcatcgctgacggcgcggatttcgaagagctgagccagatgtaccaggcgcgccgcggcgcgctggtgggggagtaagccatggcctggttcaaacagctgtcgttctaccgtctggccgacaccgttgaccagtccaccctctctgcggcgctggagcggcgcccgttccagccctgcatgggcctggattggttcagcgaaggctgggtggccccggccggccacctggacgcgcctgtctacgcagaacgcggcaacctgcttctggcgctgcgccgcgaagacaaggtgctgccggcctccgtgattcgcgactatgtcgatgccaaggtggcagaagtagaggctcgggagctgcgcaaggtaggccgcaaggaaaagctggcgctgaaggagcagctgaccgacgacctgctgccgcgcgccttcgtccgcagcggccgcactctggcctacatcgacaacaaccggcagtggttgatggtggagtcggccaccgccagcaaggcagaggcactggtctccaagctgcgcgaggcgctgccgccattccccgccgcgctgccgcgaacgaagatcgccccgcatgcggctatgaccgactggctggccatcggcgaagcgcccgatggcttcgaactggacgctgacgcggtgcttcgggatagcagcgagaacggcgcgcaggtgcgggttagccgtatcgacctgactgccgatgagatccggcagcacatcgccaccggcaagcatgcctccatgctgggcctgatctggaacgacaagatccgcttccagctgaccgactcgctgcagctgaagcgcatccagttcctggacgtgctgcaggaggaagcaagccaggccggtgacgaccgcgaaagcctgttcgccgccaccttcctcttgatgagcgaagagctaggtgaactggtcagcgcgctggtggaggcgctgggcgggcttgaggagagtcaacaacacaaggaggcggcgtgatggaacacaccttcaagcacctcgtcctgtacgaggagcgccatagcgatggcgcagtcatcaccgacgaaaacggcttcaaagtcgtggaagccaacagcatggctgttttgctcgactgggacaccaagcttggcatcggccactgggcagatgatccgcgtgccagcatggaactgaccgaagagcagcaggctgccaacgcccgccgaatcgtggcctgcgtgaatgcgtgcgccggcctgcccgacgccctggtatcgcatggactggtgcctgccagccggcattcgacggtggcgcaacagcgcgatcagttgctggcggcgctggaggctgtgtgcgactcgttccagcacgtcccgctcggccctggcgcgctgcaggacctattcagagcacgcgccgccatcgcggcatgcaaggagtcggccacatgagcaagcagcccttaaatgtgaaaaagccagcccgccagaagctagagcggttcagccatcagatcagcctcactctgtccgatggcgagcgcacgctgccgctgggcgtggccaatatccagtggaaagcccccccctggcagcactttgtcatcctcgcagcttttcatggccgccgtgctgggcgcccagcgccgctactcggccaccatcaaggggttgggcctgcgctacctctggcagatagccgacgatgccggcaaccgagtgacgcttctggaaatcgaccagcggcacatggaggccaaggataagaaagagccgctaaccatcaagcggctgggctttgactcagtcgaaatcgtatagcaggccgcgcgaagcggccattttcttgcccggcgcccgctcggcgccctggagagcaacatgaacacccacatcagcaccatgcgctacgcgatgcaaatcgccgtactggcacagctcctggagcaacgtgagcgccagatcgagcaattggctaccgtcatcgccatcaaggacgagcaactagccacccagaatagcgcggcaatggaatatgtcgcgcgctgcgacgagctggaagcccgcaatagcgagctggcgcgccagcgcgacttgctggcgctggaggcacaagaacggagggcggcgtgagctaccagacctacggcgaggactaccacgtcacgccgcggcctgatcctctgccggctgccgccggcaaggccgatgagccgcgctaccccgatgacggggtggagagcgacgggggcgagctgtagcaaccgctagatagaaaactcccagcaagcgccatgatcctttccatccatgtctcgagtaaagtgctggccgcaatcccggcagagatatttcttcagctctgtttttcggaatccagagcctccatacggctcggagccatcacatactaattttttgtgaggaggagtggcggacaactgccggttcagggtgttgcatagatcgcacggcatggaatttctccaatgtgatggagaagaaaatatatccgatttggaggccctcacgggcctctttctttttgaggaggcgcgatgtctgaaatcaccaacccgtatgagcaggtggaactggcagctgaagccgccggctatctgggagcactggacgaaggaagcggcgagcgccaatggctggcagatcactgcactggagatgaattcgatccgcgcgagagctttgaagacgcggtgcgactgatttgcacgcttggcctacttgtcgaggttgatcgcggtgcaggggtggtgactgtcgtgataggcgctgatcacgttgttgaccactgcaccatgaccgagcgtttcgaccctgacgggcgtttcgacatggatgcgccggcatccccagaatatgcgctgaaactggccgtcacccgtgctgccgctgagattggcaaatgcaaggtgatggggaccgccgcatgacctgcccctacgacagctggctgcccgatcagccggcaccaatgcccgccgcgcccgaactgtaccggccctccagcggccaggccggcgagtggttcatcagtgaatggtgcgcccactgcgagcgggacaagtgccagaacggcagcaaacccatggacgagtgtggccaggacgatctctgccaaatcctcggccgcaccatgttcctggacgtggacgacccggactacccgcgcgagtggatcgacgacccggagcacggcccacgctgcacggcgtttgtcgaaatcggccagccgctgccgcctgcgcgcgacacgcaaaccatcgatatgtttcagctgcccgaccagggcgaggagtgagcatgtccgcagtcacccgccccgcgctccggtaccacggcgcaaagtttcgcctggcaccgtggatcatgcagttcttcccgccgcatcagacctacgtggagccgttcgggggtgcggccggcgtgctgctgcagaagccgcgctcgtacgccgagatctacaacgacctggacggcgacgtcagcaactttttccgggtgctgcggaatcctctccagcgcgcgatgctgatcgaggccgtcaccctgacgccatatagccgcgccgagttcgaacaagcctgggaaccggccaccgatccaatcgagcgagctcggaggctgtccatccgcgcgcagatgggcttcggctccgccggcgcgaccaaagggacgaccggatttcgcattgacagccggcgcgaatatggcactgcgcagcacctttgggcgtactacccggaccaattggctaatgccggacagcggctggccggcgtgctgatcgagaatgcctcagctatcgatgttatgcaccagcacgatagcgcgcagacgctccatttcgtggacccgccgtacctacacgaaacccgcgtgcgcggagcgcaatatggccgttactaccgtcacgagttaagcgacaacgatcatcgcgagctgttgggcgtgctgctggatctggaagggtttgtggtgctaagcgggtacccgtcggacctctacgaccaggtcctagccggctgggagcggcacgtcacgggcagcaggatttctgcaggccgaggcggtgcagtccggaccgagtgcgtttggctcaaccccgcatgcagcgcggcgctacaccagaacgacctattcaaggagatagcatgacgcacctgacccaactggcggacgccgcgcgcgccgtcatcgcagctttcgaccgtgccggcgagctgaccgacgaactgatcagtgcgctggagctggcactgaatggagccgagctgtcgccggccaccgagcagagcggcgaggcggtggcatggatagagattcacggaagtggcgtgatatacggtgtgtatatgaacgcggcagaggatttgccgctaaacgttaggctcaatctctacacccgcccgcagcccgcgccggcggtgccggatgatggcgctgtccgcgagacgttgctaaacgtcatccgccggttaaaccagaatccgtacagcctgaccaagatcgagtgcatacgcgaggtggaggcaatgctcgccgccgcgccgcagcccctgacctgcacctgcccgtctggcgacggctcgctacgctggccgtgcccgcggcatccgccggagtcggcatgacgaccgccgcgctaccggccccgccggtctaccgctacacccagcgccgcgacggcgccgtcatctacgttggcccggagccgccggcacccgagcccggcaccagctgcacccggatggcgtggttggcggtgccgggcatggagtggggcggccagtgggccgatcccgagattgtgttttgaaggccgccagagggcggcccaacttttttctaccagctgacaggaagtaggagagcaaatgaaaaatgaaatcctggcgctcccagtaaagtgggtgcgtggagaattgtattgccgaactactggtgagccaatggaaacagtattggctcgaattcgagatggtatatgggctgcgggaaaacattataagcggactggtccgcgaactttatggattaacttgatagaggccagcatatgggtggatcaacagccgcacgtcgagtccctcttccagaaggggtcgaaatccgagaaggatcccgcggaagcagcttaagaattatgtttatctggcaagggaagcgtcggcgggagacattagacgttcctgctacgcctgcaaacattaagtatgcagcgcgattgcgtggcgaaatacaaaatgcgattgcgcgcggcacttttgattatgcagcgacattccctaattcaaagcttgcacggagtatggtgcccgcggagcgtaaacgttaccttattagcgatctattggataagcaacttgatactgcccgcaagttgcaatccctttctccatcgacaatcgccagctacacccgatgggcacgctcacggattataccgaagtgggggcaaaactatatcgacgagataacaacgcttgaattgcgagattggattgttggaatgtcggcgtcaatggccccaaaatcggttagaaattgcgtggggcttttatccgtcacgctcagtcaagcggtggcagatggcattatcacgacgaacccgcttgagccgattaagctgcgtaccctgcttcccagaaagagaaggtccgaggatgattcaatcgacccattcaacgatgaggagatcgcccagatactaaaggcggctgatgcagaagaggtccgtgctctgtggatgttcgccttcgcaacagggctgcgcacgggcgagctgatcgcggtcaagtggcgtcacgttcttgaggggcgaggcgtcatcagggtagaggacaacatagtctcgaccgatgagggggtggtcgaaaaggcaacgaagacggacacggtaagggaggtacccttgctgcctgcggccgtggaggcgctcgaaattatgaagggaatcaccatggcatctggtgccaacgggtacatcttcattaaccctaacactcggcggcgatgggccagtgagagggtgatgcggaagcattgggcggcaaccctgggggcaaccgcgcttcgttaccgaaaccagtaccagactcggcacacgtttgcctctcgcctgctaatggccggagaaccagagttgctggtggccaaattgcttggccatgtgaccgttgagatggtgcggcggcactatggccgttacatcacgcagccaaatggaatcgtgctgaagggggactattcaggctttggtaccgatcccgaaggcaaggcgggatgactgccagaatttggggcagatttggggcacgttaacccgtgtaaatcatctttaactggccgcagcctagccaagcatgaaaataaaaagccgcctgtaatccttgtagaatctagcttttgggctgatttgcgcggattaaggcggcttaaaatttggcggaggctgtgggattcgaacccacggacggttgcccgtcggcagttttcaagactgctggtttaaaccactcacccaaacctccccgaagtggctgatgtcaggactttcgcatgccgagcggctgccgtttttcctgaatcattaagagctgcggattgtatcccgacttgccgcttttgcctagagggcggcggcgtttgaggccagcatttccgccgcgtgctcgcgggtggtttgcgtcagctccgcgccgcccagcatgcgggcgatttccagcacccgctgttcagcgtccagcggcgagatgcggctgagaacctgtcccttttgctcgcgcttgctgacctgccagtgatgcttgccgcaggacgctacctggggcaggtgggtgatgcacagcacctggtagcgctggcccaggtcgcgcagcatgtggcctatcacctccgccacgcggccgccgatgccgacgtccacttcgtcgaagatcagcgtcggcacgctggccacctggctgatgacgacctgcatggccaggctgatccgcgatagctcgccgcccgaggccaccttggccagcggacgcaggctggtgccggcgttggccgccaccaggtattcgatcgattccatgccgtgcgcgccgggctcggccagcgccgacagctcgatggcgaagcgggagccgcccatcgccagccgctgcatttccttgccgatgcgctcggacagttcgcgcgcggcctggcggcgcttgccggacagcgattccgcctgcgcgcggtagcgcgccaggctggcggcttcggccacgctcagcgcttcgatgtccacgctggcttccagcgcggccagctgctgctgccagtcggccagcttgtcgcccagatcggccggctggatgcggtatttgcgcgccgcgctcatcaatagctccagccgccgttccatttcggccagctggccggggtcctggtcgatgtcgctggcgtagtcgcgcaggctgtacaccacctcgcgcagttcggcgtccaccgagtccagcagcgacagggtgtcggccaggcgcgggtccaggctggacagcttggacagccggctttgcacttgggccagctgggtgaggcagctgttgtcctgttcggacagcgtgtccaccgccagctgcgcgctttgcaccagttcggccgagttggccagccgggtgtggctttggctgagggtgttccattcgtccggctgcagattcaggtcggacagttcgccgatttgccaggtcaggcgctcgcgctccacttccgattcgcgcgacagccgctcggcgtcgttgcgcgcctggcgggcagcctgccattcctgccaggctttgtgcacgtcgcgggccagcgcgaccgaaccggcgtaggcgtccagcaattggcgctgggtttcgcttttcatcagcgactgatgggcgtgctggccgtggatgtccaccaggaattcgcccaattgcttgagctgggccagggtggcggcctggccgttgacgaagctcttggagcggccgctgcggtcgatcagacggcgcagcagcagcacgccttcgtcgccggacaattcgttggtttgcagccaggcgtcgatttccgggcgccgttcggtggagaactcggcggtgatttcggcgcgctcggcgccttcgcgcacttgcgcgccttcggcccgatcgcctagcagcaggcccagagcgtccagcagaatggacttgccggcgccggtttcgccggtgagcacggtgaagccggcggcgaagtccagcgcgatgctgtcgacgatgacgaagtcttttacggtcagcgagaggagcatggtgtgtggtaggtccaggttacagcaggcgctcgccccagtgcagcttgtggcgcagcatgtcgtagtagttgtagccttccggatgcaggatgcgcagcggattgcggtagcggcggatcagcacccggtccatttccatcaggtcgcagtgcagctggccgtcgaaatgcacgcgcgcgtccaggccgcgggtgagcatgaattccacctcgcaggagtcgttgaccgcaatcggccgattggacagcgactgcggacagatcggcaccagcgcgatggcctgcagcgtgggatgcaggatggggccgccggccgccagcgagtaggcggtggagccggtgggggtggagacgatcaggccgtcggagcgctggctgtagacgaactggttgtcgatgaagatttcgaactcgatcatcgagccgacggcgccgcggctgaacaccacgtcgttgaaggccagcgcgctggcgacttcggcgtcttcgcgcaccaccgaggcctgcagcaggatgcggtcttccggcacgaactggccgtgcaggatggcgtcgatcgacgtcagcatctcgtgcagcggaatgtcggtcatgaaacccagcctgccctggttgatgccgaccagcggcacgcggtagggcgccagcaggcgggcgatggacagcatggtgccgtcgccgcccagcacgatgcacaggtcggccagcttgcccatgtcgttgcggtctatcagggcgtggccgccggcttcttccgcgctgaggctttccttgtctatcagcacggtggagccgcccgcggccaggtggtcggccagctgcagcagcgaggcggtgatgcccggcttgctgtgtctggccaccaggcagatgtgtttgaacagtctttccatgcggtgattctactggtttggcggcgcttcgttgaaaaaactgtcttcgctgcgtttcttgccggtggcttccagcgccttcaggtagaagcgcaccagatcggccagcgaatccacgcccagcttgctgaacaggttggcgcggtggacctcgatggtgcgcggcgacaagtccagctcgcgggcgatttccttgctggacaggccgtcggccaccagttccagcacttcgcgctcgcggccgctgatgcgcgacagctggcccatcacttcctgggtttcctcttctttctgatgctgctggatgctcagccgtatgcccttgcgcaggctgtctatcagccgcgcctggtcgatcggtttggtgaggaagtctatcgcgccggtctggaaggcgcgccggcattgctcgatgtcgccgtggccggtgatgaatacgatgggaatggcgatgtcgcgctctatcagttgctcctgcagcgccaggccggtgatctgcggcatgcggatatccagcaccaggcagcagatctgattgccttggtagccgtcgagaaactccatcgcattgggaaatgtgacggttttcatgccctgggcggtgatgagcatggccagcgaatcgagcaccgccgggtcgtcgtcgacaatgaatacggtgggtgtcgtgttttgcatcaggcttctactccggatggtgccgccacgcggcgtgcgccgcatggcaggtcgatgatgaattccgctcccgagccgggtttgttgccggcgatcagcttgccgccgaaggcttccaccgcggtttggcaaatcgccagtcccagccccatgccgttgggcttggtgctgaagaacgggtcgaaaatccggtccagcttgtctggggggatgccgctgccgttgtcgctgatgatgagctgcacccgctcgccctgtcggcgggtggtcaggctgagccgtccccaggggcgggtgtgttccatggcttccaccgcgttgcgcgccaagttcagcaccacttgttccagctggatagtgtcagcgtataccaacggcaactcggttgagaagttttgctcgatgtggatgtcgtggtcctgcagttcgtagtcgagcagcgacagcgcgttgtgcacagcctgattcaactgcaccggcaccagttgctggtttttgcgggtgacgaattcgcgcagccggtggatgatgcggccggcgcggtcggcctggctgaccgatgaggtgagggcgcggcgcagcatcgccatgtcgatctcgtcgtcgtccagcaggctgaggccggcctggcagtagctcatgatggcggatagcggctgattgatttcgtgggcgatgccggaagccatttcgcccatggtgttgatgcgggcgacgcgcgccagctccatttcgtgctggcgcagccgcgtctcgctggcctccagcgcggccagcatgcggcggcgtatcggcgcggtgtcgcggaaggtgatcaccgtgcctatcagttggccgctgcggcccagcagcggcgccaccgcgccttccaccagcagcttttcgccgttgtggcgcttcaggtagcagttttgcgccaggtacaccacctggcggctggcgatggcctggtcgaccgggtcttgcaccggattgcgcgaaaactcgtaatgcagcggcaccacctgttgcagccgccgttgcagcacctgggcggcgggcaggcccagcagggcttccgcggcggggttcaggtactggatgatctgtcgggtgtcgatgctgatcacggcgtcgccgatgccgcgcagggcgacgctggcgtattcgcgttcgcggaagatgtcgtcctgtatctgttcgcgcgcctggcggttgtattccagcagcgccaggatcaccagcagcaggtaggcgggcagcaaggcgaacagcgcgctcagcaggatttccccgggcgaggcgcgttcgaactgcagctgccggctcagcaccagatcgtagggcagcgcggcggcggacaggctggcgcggtggctgagccggggcagcagggcggcgggccagccgccggtctggtcgtcggattggcgcagcagggtcacgacgccagtgtcggcgccgctgtcgtggcgttgcagcttcagggtgtaccggttttccagttgcggcggtaacgctagcagcggcttcaggtacagcacctgaacgatcacgccgtccgcctgctctatgcgtatcatcggcaccggagagggcggggaggcgcgatagaccgcctggaacaaggctagccccagttcgccattgttcagctgcagggtgggggacgaagcttgggtatggcccagcgcgcggttgatcgaggaagacagcacgctgtcgtcgagcaggtccaggcccatttcattccagtcccgcgagcccaggccgggctccgccatgctgagcggcagatagcgcggccgcggcggcgccgggcgccaggcggcggcgtcgcgccagttgttgtgttggtcgtgcaggtagtcgcgtatcagataaggcttgcccagcagctgcgattgctgccgttcgaagccggcgcgctcgtcttggtcgaccagcggctggtagccgatgtagtaaagctggggctggctttgcgccgccgccagcgccagcgagcggatgcgggcctggcggccggggtgggcgctgctgacgatgtcgccgacctccgcttgcagcagttcgctattgcgcagccgatggctgatgttctgcagcatcagctcggcggtttgctggaattcctggcgctgcaggcggaggtccagcagcagattgtgcgccagcagcaggccgaagcccagcagccagcacagcgcggccagccatttgctgcgcgccgatgcgcggagcagcagctgcagatgcgttttgatcgcgcaaaaaggtgacgggcggggcacttcgacgtctggcatgcttcaggctttgattggatgcaagtatgatgggctgccgctgggcgggcgtcattataccggcgtcgtccggttttgcgccggctagtttcgcatcagggcggcaaatcggcggcgtatttttgccagtttgggagaaatcaccagttggcagtagttttgctgctggttctgcgcgtagtagccctggtggtagccctcggccggatgaaagcgctgggcgggttcgacgcgggtgacgatggggtcggcgaagacttgttcggcgcgcagttcctgcagcgtgcgttcggcgatggcgcgttgcccgtcgtccagatagaagatggccgacgcgtactggctgccgacatcgttgccctggcggttgagcgtggtggggtcgtgcacggcgaagaacacttgcagcagggtggcgtagtcgatgcgcgcggggtcgaaatggatttcaaccacttccacgtggccgctgtggccggagcagacttgtttgtagtcggggtcggcggtgtggccgccgcaatagccggacaccactcgctccacgccgtcaaggccggagtaggcggcgtccaggcaccagaagcagccgccgcccaaaattgccttttccatagatttctccttgctcagcgccgcggcgagacggtttcgtccagctccccggcgccgaagatcctgcatgccagtctgacggtttcagtctggattgtcacggtatccgtaatcggcaccgcatatccgcccgccatggcgacgaccagcgcggcgccgtggcggcggcaggtttccatcaccaggcggtcgcgccgcgccagcccttcctggctgagggccagccggcccaggcgatcgccgcggtaggggtccgcgccggccaggtagtacgccaggtcgggcgaggcggcggcgaatacgcgcggcagcgcatcggccaggatggccaggtattcggcgtcgccggtgccgtccggcaggtcgatgtccagatcgctggagacgcggtcgaacgggaagttgcgcgcgccgtgcatggaaaacgtgaagatgcggtcttctgtggcggtgatggcggcggtgccgtcgccctgatgcacgtccaggtctatcaccagcgcgcggcggatctgcccttcgctcagcatcagcagcgcggcgacggcgacgtcgttgaacacgcaaaagccgctgccgcgtccgcggccggcgtgatgggtgccgccggccaggttgacaccgcagccttgctgcagcgcgctgcggctggcggcgatggtggcgcccaccgagcgtcggctgcgctcggccagctgcatcgaccatggcaggccgatttcgcgttgctgccgagcgtccaggcagccgttcagcactgcgtcgacataggctgagtcgtgcgcgcgcagcaattcatagcggctggcggcgggggcggggtccagccgttccggcgcgaattgcgccacttgctcggccagcagccggtatttttctgccggaaagcgatggcctgcgggcagcggcagcggaaactggtcggtgcggtagatgcgcatgctgcggctacagcgcccggatcagcgaaaagcgcggcatctgccgtccttcgtggtccacggtttcgtcgaacatgccggcggggcgggtccacagcgtgaagtcgccgtaaagcgcgcggtacacggccatcggctcaccggtttccgaatgccgggcgatgcccagcagctggtaatgccggcggttgccgtagtgctggtagattccggggacaggcatgcgaggctcctgggcgcgacggcgaaggcggctgagcatgccgcgcccaatggacggcgtcaagaatgccggctgctccagccatacacgcgaaaatcgcggtccagcgcgaaaccgtggttttcgtacagcttttgggcggccagattgtcgtgggcggtctgcagcatgatttctccgcctcccaggtcgcgggcgtattgctggcagcgctggatcagcatccggccgaagccctggccccgggcgtccggagccacgaataaatcatgcagcatccagcagggctgcagcgataaagaggaaaagccggtatacatcagggcgaagccttgcgggcggttgtcggtcgcgacgacaaacgccaccgcctggcggcggcgcagccgttcgctgaggaaatccaggcactgctccggcggctggcttaccttgtaaaaggccaggtaggcggtgaatagcggcagccagctgccgacggattcaggggtggcgatgctcagttgtgtggccatcgataatctccgtcatgttcttgcggggctgcgttacaataacgccctttttcagcaggttagacaatgaagctggtgcttgccccgatggagggactggttgacgacgtgatgcgcgatgtgctgacccgcatcggcggcatagacatgtgcgtcaccgaattcgtgcgggtcacctcggccttgctgcccacgcgcacgttcatgcgtctggcgccggagctggagcgcgccggcaatacccgcgccggcgtgccggtgcgggtgcagctgctgggctcggacgccgcctgccttgcggaaaacggcgccaaggccgccagcctgggcgcgcccggcgttgatctgaatttcggctgtcccgcgccgactgtcaaccgccaccgcggcggcgccgtgctgctgaacgagcccgaattgctgcatgagatcgtcgccgcggtgcgccgcgcggtgccggcggctattcccgtgaccgctaaaatgcggctgggctacgaagacaagagccgcgcgctggagtgcgcgctggcgatagaaagcgccggcgctggcgaattgacggtgcatggccggaccaaggtggaaggctatcgcccgccggcgcactgggattggatcgcccgcatccgcgaaaccgtggccatcccggtgatcgccaatggcgaagtgtggacgctggacgattaccgcgccatccgcgcggaaagcggctgtgacacggtgatgatagggcgcggcctggtggcgtgtccggacctggccgcgcgcattgtcgccggcggtccggcggcgccgatggattggggcgagatgatgccctgggtgctggatttcttccgccaatgctggagcaagtcgggcgagaaccgttatccggtggccaggctgaaacagtggctgggcctgctgaagcgcacctggccggaggctgagcaattgtttgaagcgatacgccgcgagcaagagcctgaaaaaatagacaatattctgatggcaagattgggtaagtagatatactcataccgcaaagcgggatctgttgttaagatcaaaaagtgccttgtttcggtataaacaaggcgctgtaatttctgccggccaccttggctgcggatcttacacttccccgataccttgcagccctccctttcacgggagggattttttttgcccgccgccatccgctatctataaaaacagaaaagcggcggagatagcatggaatccacatcctcggtcggctggctggagcggctgatcccgcctgtctggtacggctcgcttacggtcttcgtcgccgctaccgccattttcgcccttatgctttgcctggcgcggccggatagccgcaagcgggtgtcgcgcaccatgctgatcacgctggcggcgttgctggtggtcaacttcagcggccagacgggcgcggggcagatggtgcgccagagcgccgtggtggtgatggggctggcgctgatccgcttgtgggcgatgctgttgttccggctgttcatgcccgcgctgcgcctgcatccgccccgcatcctcgaagacattctggtcacggtcggctatatcggctggggcctggtgctgctgcggctggcgggcttggaccttagccacatcgtcaccacttccgcggtgatcaccgcggtgctggccttctccatgcaggatacgctgggcaatatcctggccggcctatcgctgcagttcgacaactcggtggaaatcggcgagtggatcaaggtcggcgacctggtggggcgggtggtggagatcaactggcgcgccaccacggtggaaacccgcaactgggaaaccctggtaatccccaacagcgtgctgatgaagaaccacttcgccatcctgggcaagcgccatggctgcgcccagcagtggcggcgttgggtgtggttcaacatcaactgggacacgctgcccacccagatcatcaccgtggtggaaagctcgctgcgcgaggcgcagctgccgggggtggcgttgtcgcccgagcccaactgcatcctgatgggtttcgaaaacggttacagccgttacgcggtgcgttactggctgaccaatctggcggcggacgacctgaccgactccatcgtccgcactcatgtcgacgccgcgctgcgccggcacaatctgcgcatggcctcgccgttttacaatgtgctgaccatcaaggaaaacgaaaaatacatggaagcgcggatgaaaaagcatctggaggagcgggtgctggcgctgcgcaaggtggagctgctgtccagcctgaacgacgaggaaatggtggtgctggccgaccagctgaaattcacccccttcgtcaccggcgacatcatcatgcaccagggatcggtggcgcactggctttacatcatgctgtccggcgaggtggaggtgtggatcagcctggccgacggcaaccgcaagctggtggacgtgctcaaggcgggcagctttttcggcgagatggggctgatgaccggcgagtcgcgctcgggcaccgtgatcgctcgctccaatgtggagtgcctgcggctggacaaggatgcgttccaggccattctggtgtcgcgcaaggagttggcggagaccatctcttccatcctggccgaacggctggaggagcggcgcaaccggatgccggaggagttgctggacggcggcgacccggcgccgcgccgcgccgaactggtggagcgcatccgcaactttttcggcctgagcaagcattgagcctgccgccgcggcgcggattcagacaaactgcaccggcatgaagtagtcgcggccgggccggctcaccagcacttgcggctggccttctatcatcgcccggtaggggcgcggcagccgtttccaatcgttgaatttcatcttgatgcaattgctgggcttgcccatttgactctccttcggatcagtccaccttgtggatgacgcgggtgaccacgccccagatgaagaacgaagcgtcttccggcactgtgatgggttggtaggccgggttttccggcaacagccgcaggccattcgcgcttctttccagtcttttgaccgtcagctcgccgttgagcgcggccaccaccaccttgccgttgcgcggctcgcggctgcgctccaccagcagcaggtcgccatcgtggatgccggcgccctgcatcgagtcgcccttcaccgtcaccatgaaggtatcgccggggcggtttaccaagtgggcgttgaggtcgatgtccgcttctttcagatcatcggccggcaccggcgagccggccggcacgctgctggcgaacagcggcagcgacagctcgctcaactggctccccagcgtgcggaaattgctggcttcctcgctgttggcggtgcgccagctgcggtaatcgtccagccattgctgcaggatgggcttcaggggctccggcacgcgcagggcgatggtcttgtcgccgccgaaggcggacttgcgcccggcgccgctgcgcttgccgccgcgcggcttgtcttttggctgttccatgatttgattttgtacaatatcaaatcgaattgcaagccggatggcgcgccagctgtcatctgtcggctggaaagggcgggagggcaggaaaatgcaggatggcggctgtgggttttcgatacggcggcttgcgcgccgccgcggtttgttatacgtttcatatattatttgtgtatggaacggatatgggcatagtcaagatttcggagcagatgcatgacaatctgcgcaccgccagcgaggcgttgagccgctcgatcaactcccaggccgagcactggctgcgcatcggcatgctggccgagatccatcccgacctgcgctacagcgaaatctgccagctgttgctgcgctccagccgggaaggtcaggccttggatctgcgccagcagcaagcggcggaggcgggccgatgagcggggtgaagatcaagacgccggccgaggtggcgaaggcgcgcgaagcgggcaagctggtggcggagctgctggcgatgataggcgagcacgtgcggcccggcgtcagcaccgaggaactggacgcgatctgccgcgagcacatcgtcaaggtgcagcgcgccatcccggccaacatcggctactacggctaccccaaaaccatctgcgcctcggtcaatcaggtggtgtgccacggcattccgtcggaaaagcagattctgcagaacggtgacatcgtcaatatcgacgtggcggtgatcaaggatggctggcacggcgacagcagccgcatgtatttcgtcggcgcgccgcggccggaggcgaagttgctggtggatacctgccatcgggcgatgtgggccggcatccgcgaagtgcggcccggcgcgacgctgggcgatgtcggccacgcgatccaggccgtcacccagcaggccggcttcagcgtggtgcgcgaatattgcggccatggcatcggcaaggtgtatcacgaggagcccgaggtgctgcattacggccggcgcggcgccgggctgcggctgcggccgggcatggtgttcaccatcgagccgatgatcaacgccggcaaggcgccgacgcgccagctggacgacggctggacggtggtgacgcaggatggctcctggtcggcgcagtgggagcatatggtggcggtgacgacgcagggctttgaagtgctgacgccgtggccggacggcgaaggcggttatccggcgcaggcttgagcgatggcgcgcgccgaacgcctgctggacctgctgcaattgctgcgccgccatcgctatccggtgacggcggcggcgctggccgccgagctgggcatcagcgtccgcaccgtgtaccgcgatatcgccagcctgcagttgcagggcgctgacatcgccggcgagccggggctgggctaccagctgcggccgggctttttgttgccgccgctgatgttcgccgaagaagaactggaagctctggtgctgggcatgcgctgggtggcgaagcgggtcgacgcccggctggcggacgccgccggcaacgcgttggccaaggtggctgcggtgctgccggccgagctgcgctcgcaactggaagacgccgccttgctggtggggccggcgcagaccgagcccgccgccgtcgacatggcgcggctgcgcgacgccatccgccagcagcgcaagctggtgttgcgctaccgtgacgccaagggcgaggaaagccggcgagtggtgtggccgttcgcgctgggttttttcgagcaggtgcaggtgctggcggcctggtgcgagctgaggcaggattttcgccacttccgttgcgacaagatgatcagctgcgacagcccgggcgagcgctatccgcgccgccgccaggccttgctgcgggagtggcgcaagctgcatggcatcgcggaaggcgcggtgtgacgccgcctggcggcgcttaggcgggcctggcgtgttcggcggcgtgctgggcgaggtaggcgtccagatcggctccgcctatgcccaatgtggccaggatggctgccatgaagctgaccggagcggtgccgggcgcggtgacgacgcgctggtcagcgacggcgtagggcacgtcctggtaatgcgcgccgccggcataacccggcaccgccaggttttccgccgaattggacgtatggcggacgccgttcagcacgcctgcctgcgccagcatgcgggtgccgtcgcagatgccggccagcgcgatgccgcgggcgcgggcctgggtcagcagcggcgtgaggtcgggcgcctggccggtgcgccacagcgtgccgccgcagacgatcaataggtccagctcgtcgagggaaatggactctatcgccaggtgcggagtcaccatcaggccgccggaagacgtaagcgccgcgccgcccggcgcggcgaagcggacgtcaaagccgtagtagccgcggccggcggagttgatcagggcggtttcccagtcggaaaaattctctgtgagcagggtgatggcgcgcgtcatgcggattgtccttgtctggcgtgaatgaagaaggcccgccgcggtgcgcggcgggcctgccaatctaagcggcgccagtgacaattcctgtcagcagcctgcgtctcgtccgcttggggcgcttaccgcagctgttccgaaaagtggtagcagacgatgtccatattgcggttcaggtagaagcggtgcgcgcggtggcgctgcacgcctgaatccaggtggatctcggcgcagccggcgtccagcgcggcctcgcgcagccacgccatcatcctggcgccgcagccttgcgagcgcgccgattcatcggtggacaggtcgtccacgtacaggcttttgcccatcatcaggttgcggtggatccggtagccggcgacgcaggccacctcgccgtcttccagcaaataggccagccggtagccttccgccatctgcgcgcgcacgacggcgacgaagccgtcctcttgcagatgcggccgcaactggcgcatcacggcgaaacagtcggcgatttcctggtcggtctggacgtcttggatcaagcttttctccttagcagtcaaggcgcggctggcggcagcgcctcggaaaagtggtagctggatatgcgcatgtcccggttcagatagaagcggtgcgcgcggtggcggtcgatgccggaatcgaggtgaagcctgacgcagccttccgcgcgcgcggcctggcgcagccagtccatcatccgcgcgccgcagccgcgggagcgcgcggcctcggcggtggacagctcgcccacgtacaggctttttttcatcagcaaattgcggctgatccggtagccggcgacgcaggccacctcgccgtcctccagcagataggctagccggtagccttcggccatcagttcgcgcatggcatcgataaagcccgcttcttgcaggcgcggccgcagttggcgcagcacggcgaagcagccggcgatttcctgatcggtctgcgcttgccggatcatgcgtttccaccctcagctatgtggctgtacatccagaagtcccgcgatggtccgcgcaccttgcggtagctgcgcagcaggccctcgcgctggaagccgcagcgttccagcacctggatggagcgcgcgttttccggcagcacggtggcctgaatgcgcgccaggccaagatggccatggccccaggcgagcaggctggcgcaggcggcgcgggcgatgccgcgtccctgggctgcgggagacaggtcgtaggcgatttccgcgctggcgttggctggagtcacggtgtggaaaccggcggtgccgagcaggtggtcgtcgcggctgtcggcgatggcgaagcgcagcgcgctgacttcggtgaactgctccggctgccaggcatagtgttccagctcggacgagcagcgcacgttccagctggtgtgttggtagatctgggggagggtcaggtaatcgtgccaggccaggatgtcgtcggggtacagcggtcgcagcatggcgtcggggtggtccagcgcgggcatttcggtgaacagcatgcgggttccttgttgttttgcttccagggcaaccgtcgcgcggcgcttgctcgcaggaagaatattctcacccgatgaatttttacccggccggcatttttgcgcaaggagcggccgcggcggctcgctccagcggctcagggcaaagccgcccagccatggcagcccacatacaggcccaccagcgcgatcaggccgccggagaaataaggcgccttgcgcgcgaaatcgccgaatccgctccagcgccgggacacgtgcttgacgctgacggcggccagcacgccggacgccaccatggtcagcgccaatcctatgccgaaacacagcaccagcgtcgcgcccagcgccactttcttcagctgcaggcatagcagcaatacggtgatggaagctgggcagggaatcagcccgccggtcaggccgaacatcacgatctggccggtggtgacgtcgctgttggcgaagcggcggcgaatgtcgttggcgtgggccagttcgtgcgggtcctgatagccatctgtcaaagcttccagcgcagccgcattggccggcgccggatggccatgctcggcgaaggccacgtcgtagtcgtggctgtgatggccgtagcccaggctgagccgggccatgaactggtgcggttcggggatggcttgctcggattcgataaagccgtcgcgttggacaaaggcgaagcgctggcggctgccgtccggccgttccgtttcaacccaggcctgctccgccggccagccgtggccgcgcttggcttcgtcatgcaagcggaagcgcggcggcgcgccatcttcgaatatctctaatcgtaccgtgccgtggccagtgtctatgatccggctttcatcatgcgggtgcgcatggcggtgcccatgttgatgttcggcgcgcagattgcgccaagtgcgccagaccatccagcccgccaccgcgacgatcagcgccgccgaagccagctggaaatagggctcggccttttccatattccagttgcggccgaaatacagcccggccatcgccacggcccacaccactgcggtatgggacagggtagccgacaagcccagcagcacggcctgtttcaccgtgccgcgcaccgccacgatgaaggcggccatcatggttttggaatggcctggctccaggccgtgcagggcgcccagcaggatggcgctggggatgaacagccaggcattgccttgctgcagcagggaagaaaattcggtcatggggcgcgctttcggcatgtgtatgcggcgcagtatactgccccccagtataaatatgctaccctccagtatattccccaagattcaggcagagacggcatggcgcatacgatacgagacaaggccaagttgctggcgcgggtgcggcgcatccaggggcaggccgccgcgttggaaaagcggctggatgcgggcgatgaggattgcggcgcggtgctgcagcaaatcgccgccattcgcggcgcggtgaacggtctgatggcggcggtgatagaaggccacctgtccgagcatctggtgaacgagccggagcaggcgcaaaggcagcgcgatctggacgcggtgctgcaggtgctcaagtcgtatctgaaatagctgggggctgcgcgcgccagcttgcatgcggcgcgcttgctcctgctggagatttttgatggtaaagggaacatagggcggctgcggcgatgctgccaatctgtccgaagattgcgcgcgcttgttggcgatgccttgtccctgggccggcgaagccggacaggaacagcaggccgttgtatttgacagcgtgaacataagggtaggcagactggtccagcgcggcgtgattgtttctttcaatccgcatctgaggcgttctttgcggcgtgctggatcggggtggcggatagccatgcatctcagcctggggcgcggcctggccgggcaatggaggcaagcggccaatgccgggacagccagttctggagcgttgccagcgtctgctcttcttgcaagggattgtcgccgaggctcaaccacaagaaggcttgcgcttgaaagctttgcttgcgccagtcgttttccaaacgggacttgattggtttcaaatacaggcaccccagatagtgtttgccgtccggagtcagcaggcaataggcaaaggcctggcgctgttcgaactccgcaaggtggcggcgcaggtcggccaggttttcgtcaaagctgatatcggtaggtggccagtgattttgcgggccgaacacatggcggatggcattggcgctgcggcataccgcttgatggtcggctttggcatggtcggggcttagcatctccagcctgaaatgggggaagcaagcttggcggggcggggtgaaggtcgatggcttgaatgctactgacaaaaactgacagcaggctggcttagcatgactgcatgccgaagcgatttcggcgctcacccaaggagaacagccatgcaacaccccgacttcgtgattttgtacgtggaccagccgatgcgcagcgcagatttctattcgcggctgtttgatctgcagccgatccagctgtcgcccacctttgcgatgttcaagttcgcgtccggcatgcggctgggcttgtggtcgcgccacacggcggagcctgccgccgagatgatgggcggaggcggggaagtggtcgtgcggctggaggatttcgccgcgctggatgcttgcctcgccgattggcgcgcgcaggggctgcgcattgtgcaacccatcacggatatggattttggccgcaccttcacggcgctggacccggatagccaccggctgagagcctacgtgcggacggagtgaaaacgagcggtttgggccggtcgcttgtctattgtcccgcagacgttggcagtttggcgcggatgcgggcggagggttcgggcggcgtcagggcgcgtcgcccagattggcgcagacgcgttgcagcaagctggccagaaccgcttcttcttcgcggctgaagcccgccagcgccctggcgttgccggccgccatcgcaggaatcgcctgcgccaggcgttcccgtcccagcgcggtggcttccacgatttgcgcgcgtttgccggcggcggaggggcggcgcaggatcagctggtcgcgctccagcctggccagcgtctgcgccatcgatggctgctccacctgcagcaggcgggccagttccgcctgggtggcggcttcgccgtttttcagcgccgtcagcaccggcaggctggccatgcccaggcccagcggccgcagttgcgcctctgcatggcgcgtcagcgcatgcgcagcacgcttgatcagccaggaggggacggtgcgcaattcggtcttcagcatgggaggatttcggctatttgcataggtgcctattatatgtaagcataggtgcctatgtaaataatcgtctggagattcgtcatgccgcttccttctggcgtcgccattgtcggcgcggggcccgccggcctgttgctggcccgcggcttgcttctgcgcggcattccgttcaccttgttcgatcgcgacgcctcggcggccagccggccgcagggcggcatgttggacctgcacccggacaccggccagcaggcgttgcgcagcgtcggcctgttcgaatccttcctgcggatcgcccgctatgaagaccagggcatgcgggtgttcgaccgggatggccgtctgttgatggaaaagggcgcggagggcggcgactgccctgaagtggaccggggaccgctgcgcgacatgctgctggatgcgttgccggctggctgcgtccgttggggccatgccttgcgcgaagcggaggcgctgccgggcggcggcttcgagctgcgcttcggcaacggcgcggcgcgccgttttgacttcgtggtcggcgccgacggcgcctggtcgcgggtgcggcccttattgtcccgcgccgagccgatctacgcaggcttggtgtaccacgaactgtccatctccgacatcgacgcggcgcatcccgagctgtccgccttggtcggccgcggcacgctggtggccaagggcggcggcaagacgctgttcgcgcagcgcaacgccaacgcgcaagtgcgggtctacgcggttttgcgccaggcgctggcggcggacggccggcgcgccgcgccggcaagcaaggcggagttgctggcggcgttcgctgattgggatagcagcctgcggcgcttgatccaggcggcagacgagccggcgcggccgtggcccatccatgcgctgccggtgggtcatcgctggaaggggcgcgacgacgtcacgctgataggcgatgccgcccatttgatggcgccggccggcgagggcgcgaacctggccttgcgggacgcttgcgacctggccgccgcgctggggcgcgacgattggcgcgcggcgttgcgcagccatgaggcgcggatgttcgcgcgggcggagcttgccgcggcgcgcgcgcagcggatgctggccgagggcgcggcgggcgatgggcggttgcgcgaggtgtcctgacgccgcgccggctattcgccgttcatgatcttggccagactggccggcgacggcgcgccttgggccttgcgcagcgcgcctgttgcgtcgaggtagaaaatggcgggggtggagaaggcgccgaagcgctccatcaattggtgattggcggccagtttgtcggcggcggcgcgcggcgggcgggccagcggctggatgccgccgccgggctgccgctcgtggcgcgcgagcgccgcctccgggtcggcgtcggccagcagcgccatcgccttgccggggctgtcggcttccaggatgcccaccaggatgtggcgcagctgcaccttgccggcgtccacccaagggcgggcgtcgcgccagaactggctgcaataggggcagttcgggtcggtgaagacgtagaccgcgcgcggcgctttggcgtcgccgtccgctatccaggcgctgttttccagttgccgcagcatcgccgcgccaaactgccggtccagcccggcctggttccatttgtcgccgcgcgcgtcggtgatggcgccggcgatggcgtgttggccgtccggggtcagatagacggtttgcggccggctcaggtagagcgcggcatagccggtgaggccgccgggcgcttcgaaactgtccagaatctcgtagccttgttgcgccagcgcctggatgggcgccggcagcgaagcggcgggggctgcctgcaggccgcagggcagggccagcagccatggcaggcagcgtttgcccagtgaattcatcagttgcctcttgttgccgcgcgcgctgcggcactttgccgtcgtcagcgctggggttggcgatcgcgcaagcgccgaggtggatgggcttcggcccagccttcgcggcgcgggatccagatggacagcgtttgcgggcttatgttccggcggcttggcgccgaaagggacgcgcttggctagcgcgcggcatctggccggcggcaggcgtcgggcagggcggcatccggcagggtgctgctgcaaacccagcggattcggccctgggcatccggcaccggggcgagcaccaaggtgttgaccttgtttctcggcagcgacatagatagggtgagcgcgccgctttgcttgtcgtatgctgccgcgcgcacggattcgggttgcgcgccggccgtgtagccgctgtccgccagggttgagggcaaggcgcggcgctggctgtaataccggcctatcgcttcctgatagccctggttggcgctcagcgcgtcggcaacctgggcgcggatggcgtagttctgataagcggggatggcggttgcggcaagcaggcccgcgccaaacaacgcggccatgacgatggcgatggctggcgcgatccggctgactccgccgcttttcgccagccacgccaggcgagcgtccagattcggcccggccttttgcgcgctgaggcgtatcttggcttggcaacgccggtagtaaaaggcgtctgcgcagagcggcggcaacagcagcatgcctgccatgaaggctagatacagcagggaaaggaagccgctggccttggcgcccgccagcgcggacagcaggccaatcgccagcaggaagagtccgggcagcagatagtagatcagcgcgggcagccactgcttgcggtacagcagccagaagaaggtgatgaacagattgggccaatgccagccggccccaggcttgccttggctatcgaatcgcagaaaacgcgccaggtaatattcctgccgctgggggccgatggcggcgcggtacagctgctcgcgttcggcttcgttgaagttttgcatgggcgttctcaggcggcttggcgtcaggctttgtggaagcagcggccgcacacggcgcggtagcgcgcttcgccgccgatttccacttgcgggccttccttcacccgttggcccgcgccgtcgatgcggatatgcatcgtcgccttgcggccgcaatggcagatggtcttgatctcctccacgtcgtcggccagagacagcagccaggcggaaccgggaaaggggtgtccctggaagtcggtgcgcagcccgaagcaaatcaccggaatgttgcgggagtgggcgagccggtgcagctgctgcgcctgctcgggcgtcatgaattgcgcttcgtcgatcagcacgcaggcggtgtcgccgtaatcgtgggccaggaaatcgaaaccggcgtcgaaagtgttggactcgcgctggatgttcagccgcgaggtgatcatgcccacgccgtagcggtcgtcgatggcgctggtgtacagcgccactttcttgtccatcgactcgtaattgttggcgatttgcagcagctgggtgcttttgccgctgttcatcgcggcgtagcgaaagaatagtttggccatgcggggtgcggaaacgggtgccggggcgcgcagcataccatgacggacccggcttgtgaggcccggcaaagtggcgggcggacgcgtttttgcttcccgctccacatttgttgatgagttttcgcttccgcgcggttcatctgcaatggaaagaccgcaatatgactcggcaaaacttcacgcttgccgcgccgcatcttgcggtcaatgcgtatttttcaattgggcgtttacggaacaagggggttatcgatcgtgtcagccatcttgagtcgagtttgcttcattggatggatcgcctgctttgtcgggagcggcgctgcccgcgcctccgccatcacggtaagcgccgcgccggtttcgagcttggccgatggccgcgccggcgccttcgcgttcgaatcggtcacgccggggcagatcatcgatttcgtcaagcgcgcgccagcggacaaggcggtggtgaccggcatgctgtcattgccgcggcaggcgcaaggcccggttcccgccgtcgtgatcctccatggcagcctcggcatcaatccgggggagtggatgtgggccaagcggatgaacgagctgggctacgccagcttcgtcgtcgacagcttctccggacggcatatcgcggagacggaaaaagaccagacgcggctgtcgatggcggcggatatcgcggacggctatgccgctttgcgcctgctggccacgcatccggcgatcgaccccaagcgcatcgccgtgatgggattttcgcgcggcggcgtcgccgcgctttattcgtcgttggagccattccgaaagggcgtcatcgatgacgatgtgcgcttcgccgcgcatgtcgcgttctaccccagctgcggcatccactatgcggcgaatcatctggatggcgcgcctgtcctgatgctgcttggcggcaaggacgactacacgcccgccgcgccttgcctcgactatgccgatgctttgaaggccaagggcgcgcaggtgacggtgaaagtgtatcccgacgcctaccatgccttcgaccggttcacgccgctgcgcgccgtttctagcgcgaccagcgccaggttgtgccatggcgaatatgacctggattcgggccggttcaccatggccggcagcgctggcgtcgtgtctggaggcgaggcgaagatcgctgcgcaggcatgcctgagccggggcgtcaccataggcggagaccccgtcgggcgcgagcaatcgccggcgctggtcgccgactttctgaagtcggtgttcgcgaaggatagataggagagggcgggcggccgcacgggctcgcccgccgcttgcgtgtttttccctgttcgacttggcgagtgcggccttagaagaagctggcgatctcctccagcggtttcttgccgatattggggaccatgcaatcgtccgccgggtagccggccaccagcaggatgtagggcttttcgtgggcggggcggtccagcaactgattgaggaagttcatcggactgggcgtgtgggtgagggtggccaggccagcgtggtgcagggcggcgatcaggaagccggcggcaatggaaacggactccggcacgtagtagttcttgatctcgctgccgtcctccagcacggttttcttctggccgaagatggcgatcaggtatggcgcggtttccagaaaaggtttgtctgaatccgtgcccagcggcgccagagcgtccttccattcctgcggcgcgcggtgtgtataaaattcgcgctcctcggcttcggccccttcgcgtatctgccgtttccgttccgggtcgctgacgacggcgaaatgccagggctggtgattggcgccggagggcgcggtgccggcggcgcgcagcgcgttttctatcacttcgcgcggcacgggctggctggtgaattcgcgcacggtcttgcggcggcggatgtcggcgtagaaggcgcgggagcgctccaccatttccgtttccgggtagcgctgaaaggtggagagcgggatgaaggccggttggccctggttgaacggcagtttgctcatgacggctcctttgggcgggatttgccggcggcatggccttccatgctgttgcggcgccgacgcatggatgatttctctgcggccatgcgatggaatggcagcggctttcattgtaatgcaatcggcattatgcatttgaaaagccgcttgtcatgtaattttatttcaagtaaagatacttgatatggaattatctcgccgggagggtggggaggcgctggcagggcggtaggcgcaaaaaaagcgcccgattgggcgcttgcggcgtggcggaaggttttacagatcgccgccggtttccaggatgaagctggctttggcgtcttggcccagatgctgcgccaggtagggcagcacttcgttcagcgtcttgggcagcgtccatggcgcattcaggatgaacatgccgctgccgtgcatgccgaaaccgtcggcggacgggccttgcacgtgcaattcggcgcgcagccagttcttggccggcagctttttcagcgccgggatcatttccttcatttccgcgcgctgcaggcaggggtaccacaccgcgtagacgccggtggcgaagcgcttcaggccttccttcagcgcggtgttcacgttctggtaatcgcgtttgtcttcatagggcgggtcgatcagcaccagcgcccggcgcggcggcggcggcaggatggccttgatgccttcgaagccgttggcctgctggatctgcacccggcggccgctgccttcgaagttttgctgcagcagctgcgcgtcggtggggtgtagctcgaacaggcgcaatttgtcgctttccggcatcacatcggccgcgcaccacggcgagccggggtagaacttcagctcgccgtccgggttcatccgcttgaccacctccacgtagccgcgcacggcttcgggcaggtcatcgcgctgccacagccgggcaatgccgctttcgaattcggcgtttttggtggcgtagccttccaccagcgaataggcgccggcgccggcgtgggtgtcgatataccagtagggcttgtctttctggcccaggtaattcagcagttcgatctcgatcaggtgcttgagcacgtcggcgtggttgccggcgtggaaggcgtggcggtagctgagcattattgttttctttcagatggttagttcgattccggcggcgcgcgcggcatcggcccagcccaggcgcgtcagcagcgcggagaagttctcttccagcgggcagtccagccgcagcggctggccggtgacggggtgggtcagccgcatttccacgcaggcgagcagcatgcgcgcgcagtctagctgttcggcgaacatccggttgtggcggcccttgccgtgggtggagtcgccgatgatggggtgggcgatgtgcttcagatggcggcgcagctggtggcggcggccggtcagcggcgccagctccaccaggctgtagcggctggtggggtagcgctccaccgctatcggcagctcgatgcgggccagcgtgcggtagtcggtctgggccggctgcggcgcggtttccaccttttcgcctatccactccagatcgtccgggcggcggctgagcggatggtcgatatggccggcgtcgtcggcatggccgcgcaccaccgccaggtagcgcttggccacttgctggcgctcgaactgccagctcatttcgcggctggcgtccttgtccagcgcgaacagcagcacgcccgaggtgcccttgtccagccggtgcaccgggtagacgcgttggcctatctggtcgcgcagcagctggatggcgaagcgggtttcgttgcggtccagcacggtgcggtgcaccagcaggccggcgggtttctggatggcgatcagttgatcgtcccgatagagtatctgcagcatgggaatgacgggtgtggccaggccgggattgtagggcttgcgcgccgctttgggtatagccggtttgctttgcgtccgatcaattcaaacaagaatggccatgatttgaaagcgatgcgaaaaccatcaaggcccgccccgcctggcttgcgggcggatagggtcggccggggcgggaaatgattgcgacacggtatttcaaagtcgagaggaaatggtttacagcccggttaacggtcattacaattcgccgcgctcagaagaacgacgaaagtggtgtctgcagccggtttttgcattgcgcagggagcggttcaggccgcttcggcacagctgaggctgtagtccggcggttacatgccgtctgcaatttcagctgtcaccatttcaagtccagcgctgcggcacactgcgcgcccgcatggcccgtgtgcgcgttgaccaactaactccaagagttatagagatgacaattcaattgaaacgtatcagctttgcagttgccgccgcggttctgtcggcagcggcttgcgccaaggacttcactcccgccgtgatttacgattcggccggcaagtttgacaagagcttcagcgaagccgcctacaacggcgccgagcgtttcaagaaagacttcaaggtcaactaccgcgacggccagatctcgtccgacgcgcaaaaagaacagctgctgcgcaagatggccggcagcggcgccgacgtggtggtcgccgtaggcttcaacttctcccaggccgtggaaaccgtggccaaggaattccccaaggtcaagttcaccctgatcgacgccgtggccaagggcccgaacgtgcagagcatcgtgttcaaggaacaagagggctccttcctggtgggcatggccgccgcgctgaagtccaagaccggcaaagtgggctacatcggcggcatggacatcccgatgatccgcgccttcggctgcggctacgcccagggcgccaagtacgccaacaagaacgtggctgtgctgcagaacatgaccggcaccaccccgcaggccttcaacgacccggcgcgcggcaccgaactggccaagagccaattcgaccgcggcgccgacgtgatcttcgtcgctgccggcggcaccggcatgggcgtgctgcaggccgccaagaacgccggcaagttctccatcggcgtggacagcaaccagaactacctgttcccgggctcggtgctgacctcgatggtgaaaaaagtggacgtggccgtctacaacaccttcaaggacgccaaggacggctcctggaaatccggcgtgcgcgtgctgggcctgaaggagcaagccgtggattgggcgctggacaagaacaaccgtccgcagatcacgcctgacatggaaaagaagatcgccgccgccaaggccgagatcatcagcggcaagatcaaggttgtcgattaccgcgccaacaacagctgcccggtacaataataaaggcagtgacatccccggccggtggcggggacgcagccgcgatgagtttctcgtcgcggctgtttgttcatgccggggggtggatttgaatgaagatcgggaacatataaagcatgaccgagtttgccattgagctgacaggcatcaacaagagttttggcgccgtgcaggccaaccgcgacgtgacgatgagcgtgcccaagggcagcattcacggcgtcatcggcgaaaacggcgccggcaagtccacgttgatgagcatcttgtacggctattaccaagccgacagcggcaccatccgcgtgaacggcaaggatgcgcgcatccgcaacagccaggaagccatccgtttgggaatcggcatggtgcatcagcacttcatgctggtggacaccttcactgtgctggaaaacatcgtgctgggcgccgaaggcggccggctgctcaagggcggcatggacgaggcccgcgagcacctgaaggaactgaaccgcaactactcgctggaagtggacccggacgcggtggtcggcgagctgggcgtcggcctgcagcagcgggtggaaatcctcaaggcgctgtaccgcggcgccgacgtgctgatcctggacgagccgaccgcggtgctgacgccgcaggaagccgaccacctgttccacatcctgcgctcgctcaaagagcagggcaagacggtgatcctgatcacccacaagctgcgcgaagtgatggacagcaccgacaatgtcagcgtgatgcgcgccggcaccgtggtggccaacgtccgcacctgcgacgtggacaaggaaaagctggccgacctgatggtgggccgcaaggtgacgctgaaggtcgacaaggccgagcgcgcgccgggcgcggtggtgctggacgtcaagagcctgtgcctgaccgacgagcgccaggtcaagctgctggacggcctgaacttccaggtgaaggcgggcgagatcgtcggcgtggccggcgtgtccggcaacggccagtccgaattgctggaggtgctggccggcatgcgcgcgcccagcgccggcgtggtcgcctacaagggcgaagacctgctcaagctgccgtgcaagcgcgcgccgcgcgccgccgtctaccgccgcatgggcatcagccacattccggaagaccgttcgcgcgaaggcctggtgaagagcttctccacctacgagaacgccatcctcggctatcacggcgacaagacgctgaacagcggcccgctgtattcgcgcaagaagttggtggagcggacccgcgacttcatcgcccagttcgacatccgtccgggcaatccgctgctgcgcgtgggcctgctgtccggcggcaatcagcaaaaagtggtgctggcgcgcgaaatccacgccaaccccgatctgctgctgattggccagccgacgcgaggcgtcgacatcggcgcgatcgaattcatccacaagcggctgatcgagctgcgcgacgaaggcaaggccatcttgctggtgtcggtggaacttgaagaaatcctggcgctgtccgaccgcatcctggtgatggccggcggccagatcaccggcgaagtggcggccaaagacgccgacaccatttccctcggcctgctcatgggggggcacaagcattgaaattcggacaaccatccactttgccgcgttgggcgcagctgaccatcctgccggcgctcaatctgctggccgccttgctggtgacgggcttcgtcacctggatgattggcgaaaatccgtgggaatgcctgcagttgctgatacacggcgcctttggctacggcgagggcgccggctacacgctgttctacaccaccagctacattttcgccggcctggcggtggccaccgccttccacgcggggctgttcaatatcggcggcgaaggccaggcgtatctcgctggcctgggcgtgacgctggtgatgctgggcttcgaccacacgctgccgtcctatgtgctgattccgctggcggtgctggcggcgatgggcttcggcgcggcctgggcctacatcccggcctatctgcaggccaagcgcggcagccacatcgtggtcaccaccatcatgttcaacttcatcgcctattcgctgatgttgtacctgatcagccaccagttgatcgaagccggctcgcaaaacccgaccacccgccagttcgccgaaaccggctggattccgcagctgcacacgctgttctcgtcgctgccgaattcgccgctgaacctgaccttcgtgctggcgctgctggcgtcggcgctgttctacctgatcgtctggcatagccgctggggctttgaactgcgcaccgtcggcaccaacgagcacgccgccggctacgccggcatgagcgtcagccgcgtcatcatcatcgccatgtgcgtgtccggcgcgctggcaggcctgtcgtcggtgaacgatctgctgggctcctcgcatcggatgaacgtgctgttcaccaacggcgtgggcttcgtcggcatcgccgtggcgctgatgggccgcaaccacccggtgggcatcatcctgtccgcgttgctgttcggcgcgctgacccagggcggctccgacctgtcgttcgagaaaccgatgatcacccgcgagatgatcctgttcatccagggcttgatcatcctgttctgcggcgcgctggaaaatctgttcgagccgttcatcgccggcctgttcaagcgcaaggacaaaaaataatggaaatgttcttcagtcttctcgactccaccgtccgcgtggcgacgcccctggtgctggccgcgctggcgggcatgttctccgagcgctccggcgtggtggacatcagcctggaaggcaagatgctggtggcggccttcgcttccgccgccgccgcctacgtcacccacaacccgtggctgggcctgctggccggcatcatggccgcggtgtcgatggcgatggtgcatgccttcgtctccgtcacctataacggcaaccagctgatctccggcatggcgatcaacaccgtagcttccggcatcacgccggtgctgggcctggcctggttccagcagggcggcaactcgccgcagctgccggacgaaggccgcttccacgagatcgtgctgccgttcgccgacgcgctgcgcgacgtgccggtggtgggcctggtctacagcaagctgatttccggccacagcattctggtctacctcaccgtgttcgtcgtgattccgctggtgacctgggtgctgtacaagacccgtttcggcctgcgcctgcgcgcggtgggcgaaaacccgcacgcggccgacaccgccggcatctcggtggccaaggtgcgctacaccgccttgttctggggcggcgtgctgtgcggcatggccggcacctatctgtccgtctaccagaccggcagcttcatcaaggaaatgaccgccggcaagggcttcctggcgctggcggcgctgattttcggcaaatggcgtccggtgccggcggtgatcggctgcctgctgttcgccttcgccgatgcgatccagattcgtctggaaggcgtggcgctgccggtgatcggccagattccgtcgcaagccatcgcggtgattccttacgtgctgaccgtgctgctgctggcaggcttcgtcggccgggcgctggcgccgaaggccatcggcgtgcctttcgtcaagtcgcgctaagccgcgaagccgcaccccgaaaagcccgccggcttcctgttggcgggcttttcgcatgctcgcgcgtgctatgatgggcgatcgaatccgatccggacgggacacattttcatgttgagctaccaacaggcgcgcgactggctgctggaacgcgccaggccgctgagcgcgcggcaaatccttcccctggcgcaaattcatggccgcgttctggcggagccggtgcgggcggcgctggacgtgccgccgcacgacaacagctcgatggatggctatgcgctgcgttgcgccgacttcgccgctgccatgccggtgtcgcagcggatcgccgccggcgcggcgccgcagccgctgcaaccgggcagcgcggcgcgcatcttcaccggcgcgccgatcccgccgggcgccgacgcggtgatcatgcaagagcaggcgcagctggacgccgacggtaaggtgagattcgccgccgcgccccgtcccggccagaacatccggctgcgcggcgaggacatcgccaacggccaggaaatcctgccggcgggccgccggctgaccgccgccgatctggggctggcggcttccatcggcctcgccgcgctgcccgtgctgcagcccttgcgggtggcggtgttcctcaccggcgacgagctggtcgagcccggccagccgctggccgccgggcagatctacaattccaaccgctactggctgctgccggcgctgcggcaactgggctgcgaaaccatagacctgggcgcggtgcgcgacgacctggacgccacccggcgcctgctgcgcgacgcggcggcggccgccgacgtggtgatcacctgcggcggcgtgtcggtgggcgaagaggatcatgtcaaggcggcggtggaggccgaaggcgagttgacgctgtggacggtggcgatcaagcccggcaagccgctggcctgcggccggatcggcgacgccgacttcatcggcctgcccggcaatccggtgtccggcttcgtcacgctgcagacgctggtgcggcctttcctgcaaaagcggatgggtttgccgttggcggagcaggcgatccagcgctatcctgcggccttcgcctggccgaagccggacgcgcggcgcagcgagtttctgcgcgtgcgcaggatgctgacggacgagggctggcagctggagctgtatccgcagcaaagctccggcgcgctgacctcctgcgcctgggccgacggcctggcctggctggaaccaggccagacggtggcgccaggcgacagcctgcgctattgggcgctggacctggcgtgacgcgcatccgctttgtcggcgagagcggcgccttgcttggcgaggcggacgcgcaggcgggcgacaatctgctggacatcgcccgcctggccgacgtgccgctgcactggcgctgcggccagggcacctgcggcacctgcaaggtgaaagtgctggccggcatgggcgcgccgcagcggccggggcgcaaggagcgcaatgtgttgctgcgcgccggcgccatcagcgagcagctggcgggaatggaagagtgggaggaggctcagccttggcggctggcttgccatctggcgctggcggagagggcggattgggaagtgctgtgtcccgatgactgagccgagccgccgcgatgaaaaaagcccccgggagggggctttgtcgttttcggggctcagccctgctcgccttcgcaggccagctcctcgttgtcgtcgcgctccagccagtggcgcagcatggtcaggcccaccgccagcagggtggggccgatgaacaggccgatcaccccccaggcgatcaggccgccgatcacgccgaggaaaatcaccgacagcggcatctgcgcgccctggctgatcaacagcggcttgagcacgttgtctatggtgttgatcagcaagaagccccaaaccagcaggaagatgcccatgccggtgtggccggtgtagaacacccagccggcggcgggcagccagacgatcagcgtcggcatctgcgccaccgcgacgatgaagcacaggaagcccagcaccagcgcgccgggcaccccggcgatcagcaggccgatcacgcacagtatggtttgcgccagcgcggtgcccaccacgccggtggtgacgctgcgtatggtgcgggcgatgacttccggcaggtcgctggcggtttcgccgcccagcttcaccacgatgcgctccaccagctcccacagcttgtcgccgttgatcagcagcaggcctgccaccacgatggccagcacgatttccagcaggctgaggcccaggttggcgccgcctgacagcagccacagcgccgcatcgttgatggcggggcgaatcttctcgaaaaagccgggcagatcggcttgcacgccttgccacatcttctgcaggctttcgccgaccaccggcagattcaccagccaggatggggcgtcgggcaggcggaagctggtcagatcgtgcgccaggttggccagatggggcagggtgtcggccagcgtcagcgccatcagcccgatcggaatggccagcgcggcggacagcgccagcacgatcagcagcgcggccagcttgcggcggcccttcaggcgcaggcacagccggctgtacagcggccaggcggaaatggcgatgatggccgcccaggtcagggcgccgagaaagggttgcagcaccttgatgcaggaaatcaccagcagggccaggatggcgatgcggaacacgctgaggatgctgatgttgggaaaaccattggcgacgggcatggaagcttccgaggtgggtaggcggaacgagacggccggcgcctgagacgccggccggaatacggcgctagtttgccaccttggccagctcccgggcaaatgcctctgccggggtgtagcccaccacgcggttgcgttcggccgcttgcgcgtcgaacaggatgatgcccggcgggccgaacaggccgaagcgcttgagcagcgcctgatgctcggggctgttggcggtgacgtcggcgcgcagcagcgtgaaccggcccagcttggccgccacctgcgcttgcgggaagacctcggcctccatttccttgcaggcgatgcaccagtcggcgtagaagtccagcagcagcggcttgcccgcggccttggcctcggctagcctggcgtccagctcggcgctggaattcaccggctggaagttggcgtgcggctgggcggcgccttccgcgttgctggcggcgatcagcttgagcgggtagcgcggattgtcggcgccggagagcaggccgaccagttgggcggcgcccagcaggaacagcagcagaccgagcgccttgcccagccgcgcgcggctgccggtgccggcggacaggctgtcgaacgcgccgaggaacaccgcggcgccgatcagcagcgccgcccacagcagcatcaccagcgcggccggcaggaagggggtggccagccagatggccaggcccagcatcagcacgccgaaggccgatttcaccgccttcatccagttgccggcgcgcggcagcacatggccgccgaaggtgccgatggcgatcagcggcaggcccaggcccagagccatcgcgtacagcgccgcgccgcccagcgccgcatcgccggtgctgccgatatagcccagcgccagcgccagcggcggcgcgacgcaggggccgatcagcagagccgacagcgcgcccatcaggaacacggtggcggccttgccgccggacaggcggttggaggcgtcgttcagtcgcgactggatgctgctggggagctggatggagaacaggtcgaacatcgacagcgcgaacaccaccatcagcgcgctggcggtcagcaccacggccggctgttgcagccagacggtgagcagcgagccggtgaggccggccgccacgccgacggcggtgtaggtaagcgccaggccttgcacgtagatcagggacagcagaaaaccgcggcggcgggtaagtgtggtgccctggccggcaatcagcgatgaaacgatgggcagcagcgggtacatgcaggcggtgaacgccatgcccaagcccgccagcaaaaaggtgcccagtgtgggcagccaccctttggctgccaactcgctgttaccggccgacgcttttcccgaggtgccgacctccgtccaggcgctaagcttgttgccggagccgcccgcctgccccaccttcagcttgtgggtgtagggcgggtagcagacgccggcctcggcgcagccttgcagcctgacgttcagctggaagtcggccggcgcgccggccgccagcggaatggcgatggtctgcttgccgtggtagatgacctgcttgccgaagtaagggtcgctcttttcctggccggccggcagcgcgggcttgccggtcaggtcggccggggcgctgctgatgctgatgcggtcgcggtacaggtagtagccgggggcgacatccagcgtcagctccaactggtcgccatggcgggcgaccttggcggcgaacgcctgttccggcggcagcagatcatcctggttgaccgcgtgggcgggcagggcgaagctcagacaggcgagcagcgccgccagccattgccaggcggttcggtaggtggaatataggtatgcttgcacttgcagactcttctgggggttggcgatgagggtgtgacgacgcggacggaagacggttccgtttttatgcggcgtgatgcaatatgcatcaaatcacgcgatccggcaaaccggaaggtctgcgggttcagcggctagtatatccgggccggacggcggcaggcagccgccggcttgtgaaaaataagaatgaggttatcagaggggcttatgcgggaaaccatacacttcgcccacgccaacagttttccggcgtcggtgtatcgcaagctgctggggcggctggccgaacgccaccacgtcggctatctcgacaccatcgggcatgatccggcctacccggtcaccgattgctggccgcggctggtggaggagagcatccgcttcatcgagtcgaactacgccggcccggtggtcggcgtcgggcattcgctgggcggctttctgatgttttacgccgccttgaagcggccggagctgttccgcgccatcatcatcatggattcgccgctgatggggccgtcgcgctccttcggcatctggctggccaagcggctgggcttcatccagcgggtgacgccgggcggcaacacgctgaagcggcgcgacaactgggcgtcggtggagatggtgcgcgattacttcgcccgcaagccggcgttcgcccgtttcgacccggagtgcctggccgactacgccgaactcggcacccaggacgacggccgcggcgggcggcggctgaaattccgcccgcaggtggagcatgacatctacgccaccttgccgcacgatttcccccgccatcgcggccggctcaaggtgccggcggcttttttagccggcgccggctccgacgtgctgggcgaatccgacctgcgcttcatgcgcaggcatttcccgatgcgggtggaaacccagcggggcagccacctgtttccgctggaacacccgctagagacggccgaccgcatcctgcagctgctggagcaactggcgccgcgccagccgtgagagccggtcttttgcgccaggtgcttgcgagcggcggccatctcgcggaaacttagcctatcgaaaggccagtttgtcatcgtgaaagacgggaacccgtgtcggaatcactactcaagcaacaccgcgacgccatcgacgccatcgacgtcgaaatcctcaccctgctgaaccagcgcgccagccatgcccgcgagatcggcgagatcaagggcggcggcatcatctaccgtccggagcgcgaggcgcaagtgctgcgccggctcaaggatctcaaccccggtccgctgccgagcgagtccatcgcccgcctgttccgcgaagtgatgtcggaatgcctggcgctggaaaagccgctgtccatcgcctatctggggccggagggcaccttcagccagctggccacggtcaagcacttcggccatgccgcccgcgccgtcgcctgtgcttccatcgacgaagccttccgcctggtggagtcgcgcgcgctggattacgtggtggcgccggtggaaaactccaccgagggcgcggtcggccgcacgctggacctgatggtcagctcgccgctgaagatttgcggcgaagtggtgctgcgcatccatcaccatctgctgcgtagcgcggaggggtttgacggcatccgccgcgtctacgcccatgcccaggcgctggcgcaatgccacgagtggctgaacaagaacctgccggccgatgtcgaacgggtgtcggtcgccagcaatgccgaggcggcgcggctggcttcggaagatgcctccgctgccgccatcgccggccaggccgccgccgagcgttacgcgctgctgaaactggcggaaaacgtagaggacgagcccaacaacaccacccgtttcctggtgctgggcctgcaggatgtcggcgtcaccggccaggacaagacttcggtcgtggtgtccgcccccaaccgcccgggcgcggtgcaccagttgctggagccggtggccgccaatggcgtgtcgatgagcaagttcgagtcgcggccatcgcgcgcgggactgtgggactatgtgttcttcatcgacctggaaggccatcgtcaagacgagcgggtgcaaaaagcgctggctggcctgggcgagcgcacctccttcgtcaaggtgctgggctcctatccggctgcggtgttgtgaggctttaagactccaacggggccggaactgtccggcccttgttcttttgggaatgcatgagatgagcgagataaaagcgatctgcctgttttgcggctccaacaagggcgccaagcccgaatacgaggccgccgcccggattttcggccgcacgctggccgagcggggcgtcacgctggtctacggcgccggcaaggtggggctgatgggcgtggctgccgacgcggcgctggaggccggcggccgtgtggtgggagtgatccccgaatttctgaaggccaaggaagtggcccatctggggctgagcgagttgcacgtcaccgagaccatgcaccagcgcaaggcgctgatggctcagttgtccgacggtttcatcgccttgcccggcggtttcggcactttcgacgagctgttcgagattttgacctgggcgcagctgtcggtgcatgacaaaccggtcggagtgttggatgcggcaggcttcttccagcctctgcaagccatggtgcgccatgcggtggaagagggcttcgtgcccccgggcaatctcgatctgttccgcatcgacgccagcctgccggccattctggactggatgcgggcttatcgcccgcaaccggtggccaagtggctggagctggcgaaaacctgatgccggccatgcgttctccgtccgccaatcgggcgactgtctggcagcgcctgcgccgcgcggccagctggccgctggtgctgctgctggccgccgtcatcgcgtttgaagagtatgcgtgggacgagcttgccgcggggctggcgtggctggccaagtggccgccgctgacgcggctggagcgctgggtggccacgcgttcgccgcgcgtggcgctggcgctgttcctgttgccggcgctggcgctgctgccggtgaaactgggcgctttgttcctgatcgagcaggggcacgcgctgttggggctgggggtgattctgctggccaagctgggcgggacggcgctggtggcgcgcttgttcgcgctgacgcgtccggccttgatgcaggtggcgtggttcgtccggctgtacgggaagttcaatgcctgccgcgattgggcgttcgagcggctgcgcagttcgctgccgtggcgttgggcccggctggcgttgcgtcgggttaggcgttggcgcggacagccgtcggcattctcgcggctggtgcgcaggctggccggcaaatggacgcatgcgcggcgttccgagggacggagcggcgcgagaggggaaaccgaatgatcatagtgatgagcggcaaggccgcggaagcggatatccaggcggtggccgagcgcatcgccgccgccggcttgagcgcccatgtttcgcgcggcttggagcgcacggtgataggcgcggtgggcgaggagcgcgggttggagccggcgatgttcgaagacctggccggcgtggagcgcgcgttgcgggtggtcagcgaataccggatcgtctcacgcgaggcgcagccggagggcagcgcgatccgcatcggccattgcgaattcggcgacgccggcttcgcctggctgggcggttgcgcctccgcccgcgggctggatgagctggcgccggtggcgcgcagcgtcagcgaggcgggcggcgggctgatgttcggcggcggcgcgcgccgtcacggcaatccctatcagcaccagactttcggcgtcgccgaactggaggccttgcgcgaggtttccagccgctttggcctggccgctgcggcggagctgtccgatgtgcgcctgctggacatgcatcttgagctgcaactggacgcgctgctgatcgcgccggacagcttgcgcaatatcgagctgttgcgcgaaatcggccgcatcaacaagcctgtcatcttgcagcgggacaatcggacatcgccggccggctggctgctggccgccgagcgcatcgccgccggcggcaaccaccagatcgtgctgtgcgattgcggccgcgaaggcgacggcccggggatggatgtcggcgagatcgcctggctgcggcaggagacgcacctgccggtgatcgcggcgccggtcgccgccggcgggcaagcgctggcgcaggtgctggcgcgcgcggcgctggccgccggcgcgagcggcctgctgctggagaccgaccgcgacggcagaatggcggcgggcggcctggcggattggctgtcgggcctgcagccggttgggcgttagcagggcgatgcgatgacggcgctgccggagctgttgggcaagatcgccgaatgccaagcctgcgcctcgtcgttgccgcatgcgccgcgcccggtgctgcgcgcctcgacgcgttcgcgcattctgctggcggggcaggcgccgggcagccgcgtgcatcagagcggcatcccctgggacgatgccagcgggcggcgcttgcgcgagtggctgggggtggacgaggcggttttttacaatgaagactgcttcgccatcgtgccgatgggattctgttatccgggcacgggggcgaacggcgatttgccgccgcggccggaatgccggcggttatggcacccgcagttgctgccgctgttgacggatgtgaggctggtgctggcggtgggggcctatgcccaggcttatcacctgccggaccgcaaggcgacgctgacggaaacggttgccggctggcgcgaatatctgccgcgccgcatgccgctgccgcatcccagtccgcgcaaccagctatggctgagccgtcatcgctggtttgaagaagagctgttgccggaactgaaattgcgggtcgccgccgcgctggagccttgatcgcggcggctcggcctgcctatgagcaaaaactctaaaattgtggattttccccatgcaccgggcgataatgccgcccagcactatggagagacccgtcacaatgaagtgtgttgatgattttcgtctaaggctgggcaagcaggagctggtccccgtcatgataggcggcatgggagtggacatttccaccgcgaccctggctttggaagccgccaggctgggtggggtcggccacatttccgatgcgatggttcccaccgtcaccgaccgccgcttcaataccaaatacgtcaagagcaagctggcccgttacaaattcaacgtcgaaaacccggacaagtcgctggtgcagttcgacctgggcctgctggaggaagccacccgcctgcatgtgggcaataccatgcagcgcaaggagggcggcggcctggtgttcatcaactgcatggaaaagctgacgatgaacgcgccgaaggaaacgctgcgggtgcgcatgcgggccgcgctggacgccggcatcgacggcatcaccctggccgcgggcctgcacttgggctctttcgccctgatcgaagaccacccccgtttccgcgacgccaagctgggcatcatcgtgtcttcgttgcgcgccttgcagctgtttctgaagaagaacggccgcagcggccggctgcctgactacgtcgtggtggaggggccgctggctggcggccacttgggcttcggcatggattgggcgcaatacgatctcgccagcattttcggcgaaatccgcgactggctgcggtccgagcagctcgatattccgctgatcccggctggcggcatcttcaccggcagcgacgccaccgcttttctggaagcgggcgccggcgcggtgcaagtcgccacccgcttcacggtcagccgcgagtgcggcctgccggagaaggtgcagcaggagtatttcaaggccagcgaggaagacatcgaggtcaaccagctgtctcccaccggctatccgatgcggatgatcaagagttgcccggccatcggcgacagcatccggccgaattgcgaagcctatggttatttgctggacgccaagggcagctgctcctacatcgacgcctatcacaaggcgcaacaagaggccgcgccgggcgccaagcgcgcgccagtatgggaaaaaacctgtctgtgcacccatatgcgcaatttcgattgctggacctgcggccattacgcttaccggctgaaagatacctcgcaccgccgggaagacggcagctatcaactgttgagcgccgagcacgtgtttcaggactaccagtacagcaaggacaacaagatcgcgctgcctccccgtgaggtgtgcctgatggtgggctgaggcgcggttttccgcttggttggcggcatccattccctgaggggattgggtgccgtttttgcattgtcgatggcgcgcggcatgcagtggcttaggaggggcagccattctaatggcattgcgctttccgtttgtccatggcagtcttgctggctgttctggccggaacctgcgccgcaggccggctgattgtttgcatcatcccctggcctgttctaccatcggcgcagcaaacggctttgcggagcgcccgtttgcgggcggagcgccatgcctgcatcgcatagttgcggtatattccggaatgatttccattttcttgcgaacaagtaataaacaatgagcaaaatcgacaagcatgaccagcaggaagcggtttcccaaaaaatacgctatcgcttgaaacaggcgggagcgcgcttccacgccaacgacaatatcgccgccttcatcgaggagggcgaactggacgccctgcaggacgaagtgcaggccaaattggcgggcgtgctggaaagcctggtgatcgataccgagaatgaccacaatacgcgggatacggccaagcgggtggccaagatgttcgtgcgcgaggtcttccggggccgctatgcggcgatgccgtccagcaccgagtttcccaatgtcgagcgtctcaatgaattgatgatcgtcggccccatcacggtgcgcagcgcctgctcgcatcatctgtgccccatcatcggccgggtgtgggtgggcgtgatgccgaatgaaaattccaatttgatcggcttgtccaagtacgcgcgtctgatcgactgggtgatgacccggccgcagatccaggaggaggcggtgtcgcagatcgccgaattgttgatgcgcaagctgcagccggacggtttggccatcgtgatggaggccgaccacttctgcatgcactggcgcggcgtgaaggacagcaacagcaagatgaccaatagcgtgatgcgcggctctttcctcaccaaccccgatctgcgccgcgagttcctgtccctgatgcacaaaccctgaaaggagcatggccatgctggttcgcctgatctattgcagccgggcgcaacaactgatagaccaggcgctggtggacgacatcttgagcgcctcgcgtaaatacaatcccgctctgggtatcaccgggctgctgtgctacagcaaggatgtttttatgcaggttgttgagggcagcagggcgcatgtcaaccgcttgtacctgaagcttgcgcgcgatccccgccatcattcgctgaccttgctgtcttttcacgagatagagcagcgcaagttcgccaactggagcatggctgaggtggcgctggacaagctgaacgcctcgctgatcctgcgccattcgccgctgccggcgctggagccgttcaccatgcccggcgccggcgcggaacgcctgctggaggatctggccgaatccggcagcatccagtaccgctgagcattttctcatgcgggcggcttgtcgccgccctcgctttatgacatccacggaaaacaaaccatgtcccgattccgcatcatcgccgcgctggccctgctgggcgccgcagcggcagtccaggcggcgcccgccgtcaaaaccttgccgtccggcgtcaagatcgagatcctcgccgccggcaagggcgcgacgcccaaggccagcgacaccgtcaaggtgaactaccgcggcactttcaaggacggcaaggagttcgatagctcctacaagaacggcggcccgatcagcttcccgctgaatcgcgtgattccgtgctggacccagggcgtcagcgcgctcaccgtgggcagcaaggccaagctgttctgcccggcggccaccgcttacggcagccgcggcgcgccgggcgcgatcccgccgaataccgatctgtatttcgaggtggaactgctggaaatccagaagtaagctcgagcgatgataaaaaaagcccgcatgcgcgggcttttttgttggcgggaggcgtccggcgctcaggcggggaacagcgccgccagcggcgcgacgatgcgctccaggtaatcggcgtcggtctgatcgaagctggagagctggtccgaatcgatgtccagcaccgcgacgactttgccggcggcgtcgcgaatgggcaccaccacttcggagcgggcgctggacgagcaggcgatgtggccggggaaggcgtcgacgtcgtcgaccagcagcgtgcggttctgcgcccaggcgctgccgcagacgccgcggccatgcgggatgcgggtgcaggcgatggggccctggaacggccccagcaccagctgctcgcccttgaccaggtagaagccggtccagagccagtcgaaagtcatcgccagcgcggcggacaggttggccagcgcggcgacgaggtcggtttctccggcgacgagcgcgtgagcttgcggcagcagcgcctggtatttctcttccttgccgccgttttcgacgatcagatgttcagccatgggtattgcttgtcagttgggtgggatgtgacagcatacacggctttggcaaaaagaaaacgccacccggggtggcgttgttctcgaccggcgctgccggcgtcacatcatgtgctggccgccattcatggcgatattgctgccggtgatgaagccggcgttttcggagcagaggaagccgaccagcgcggcgatttcttccggcttgcccagccggcccaccggaatctgggcgacgatcttgctgcgcacgtcctccggcaccgccatcaccatttcggtggcgatgtagcctggggagatggtgttgaccgtcacgcccttcttcgccacttcctgcgccagcgccatggtgaaaccatgcatgccggccttggcggcggagtagttggtctggccgaactggcccttttggccgttgatcgacgagatattgacgatgcggccgaaacccgcctccagcatgctgtccagcaccggcttggtcatattgaacaccgagtccagattggtgcggatcaccgcgtcccaatcgtctttgctctgcttcttgaagctggcgtcgcgggtgatgccggcgttgttcaccagaatgctgatcgggccgatgtccttggcgatgcgggcggcgatgtcctggcaggcggcgaagtcggtgacgtcgcattggtagctgtggatgtcgttgaagccaaggcccttcatgtcggcatgccaggcttgctcgcggcccggtttgctataggtggtcactacgatgtggccggcttctgccaatgctttgcaaatggcggatccaatgccgcccatgccgccggtgaccagcgcaatccttttcgtcatgatgctgactcctctgtcgttgcctacgtttattcttccgtaatgctcattcccttttgttacagcatatgtaggcagccataaaaagtaaataaagagcgtgtgctcttttatttacaatcttaccggcgctagctcttgagtcagccgttgcagcaagtccagccgatgccggctaatggcgcctgtttctgctgcagccatgatcgcacaattcggctctacgcgatgcgtgcagttgtggaaacgacactggccaatatactggcgcatctccgggaaatagtggattaaatccgctgcttgcaggtgctttaagccaaattcttgcaggcctggcgaatcgatcaggtgactgctttcgtccaggtggtatagcgccgcgtgggtggtggtgtggcggcctgagtcgagcgcgatggagatgtcgccgatgcgcgcgttggcgtccggcagcagcgcgttggtgagcgtggacttgcccatgccagactgcccgaccagcacgctggtatgcccttgcagcaagggcagcagcggcgagaaatcctgcttggccgacaatgtgaccagttggtaaccaagctttacatagagttgcaatttcgccagcagcgccggcgtttccggcaggtcgcacttgttgaccacgatgacgggttcgatgtcgccggcttcggcggcgatcaggcagcggcccagcagctcttcgttggggctgggcacggcggcgatgacgaacaggatgcggctgacgttggcggcgatcaccttggccttccagtcatcctggcggtaaagcaggctgctgcgctcgcgcgagcgctcgatcaccgcctgctcctggttctggatcaggatgtcgacgaaatcgccgcaggcgaagtcgacgcgcttgccgcgggtggtgcaatcgtaggtgcggccgtcggcttcgacgatgaaacggcggccatggctgcgtatgatctgtccggtgctggctgtcatgggcggctgatcagggcttcggctttggccgcgcagatgaagtcgttgagggtgaggccgccggcgtcgtgggtgctgaagttcaccaccgcgcggttgtagtgcaccgacatgtccggatgatggtcttcgcgatgggcgatccaggccagcgcgttgacgaaggccatggtgtcgtggaagtcggcgaagcggaaggtcttgctcagctcgatgccgtcgatttgccagtccggcaggccggacagcaattgcttgacggtgttttccgccagcgggctttggccgtgttgcggggtgcaggacagttccagcagattcatgattggcttcctttcaggtgttggatgcgcagcgcggcgggcgggtgcgaatcgtagaaggcggagtggatagggtcgggcgtcagcgtggcgccgttgtcgcggtacagcttcaccagcgcgctttgcaggtcggcggcgcgggtttcaccggcggcgaagtcatcggcctcgtattcgtgcttgcgcgacgagcggctggacagcggcgtcagcgggaaggtgaaggcgggaatggcgatcatgaacagcagcagcgccatcgccgtgctgggcgcggtgacgccgaggccggcgtagaaccagggcgcgtgcagcaactggccgagcagggccaggaacagcagcgacagcgtgaaggccaccgcgatgcgcttggcgatgtggcggcgcttgtagtggcccagctcgtgcgccagcaccgcttcgatctcgtcgtggctcagcttttccagcaatgtgtcgtagaacacgatgcgcttgccggcgccgaagccggtgaaataggcgttgctgtggctggagcggcgcgagccgtccatcacgtaaacgccgttgctgcgaaagccggtgcgggcgagcagcgcgtctatcctcgccttcagcgcctcgtccgccaatggccagaacttgttgtacagcggcgcgatcaggatcgggtacagcaccagccccagcaactgcaccaggcacagcaccagccacacccacagccaccatgcaggcccggcgatgtccatcagccacagcactaccgccagcagcggcaggccgatcaggatggagatgccgatgccgcgcagctggtccagcaggtaaagccgcggcgtcattttgttgaagccgaagcgcacttcgacgccgaaggtgccgtacaggctgagcggcagcgatatcaggctgctgagcacggtcatgcagacgatcagcgccatgccggacagcagcggggaggcgaaccactgctggctgtggagggccagccactgcaggccgccgccgaaagtgaaggcggccgccagcgcggtgtccacccaggccgacagcaggccgagccgtgttttggcgatggtgtagtcggcggcgtgcctatgctgctccagcgtgatattgtcgcggaaggcggcgggcacggcatggcggttgccgccgacatggcggatgtggcgccagcccagccacagcttcaggctgagcgtggccgccagcgcgatggcgaagagtagggagaatgcctctatcatgggtatccgtacgggtatcgggtttgccgcggaggcggcaatgaaggaaaatggcagggttttctaaagactgactagtatggcacaagataccaataacctcatctggctcgacatggaaatgacgggcctgaatcctgactccgaccgcatcatcgaagtggcgatgatcgtcaccgacagccatctgaacgtggtggccgagtcgccggtgctggtggtgcaccagagcgacgccatcctggatggcatggacgactggaacaagaacacccacggcaagagcggcctgatcgagaaggtcaagaactccgctatcaacgaagccgaggccgaacaagtgctgctggcgttcatgatgcagtacgttccggagcgcggcagcccgatgtgcggcaacaccatccatcaggaccgccgcttcatggcgcgctggatgcccaagctggaggcctacttccactaccgcaatctggatgtttccacgctgaaggagctgtgcaagcgctggaagccggaggtggccaagggcgtggtgaagcgcggcaagcacgaggcgctggcggacatcctcgagtctatcgaggaaatgcgctactaccgcgagcacttcctcaagctttgaggcgcggggcaacattgcctgacagcggggccggcgcggagtaacgccggcccttttgttcaccagttcatcattccactggcagaaaacatggtcgcacatcgccacgccgacataaacgccacgccgatctgggccaagctgcaccagcatcagcgcgccacccgccacatgcatatgcgggagctgttcgacaccgaccctcagcgtttccagcgcttttcgctggagttggacggactgctgctcgactactcgaaaaaccgcatcaccgagcgcacgctggaattgctgttcgacctggcgcaggcggccgacctgaaaggctggatggagcggatgcgcgcgggcgagcgcatcaatgtcagcgaagaccgcgcggtgctgcacaccgcgctgcggctgccggcgggcgccgcattgcagctggacggccgcaacgtgacggcagaagtgcatgatgtgctggacaggctgcgccgcttcagcgacagcgtgcgcgacggcgcctggctggggttttccggccagaggatacgcgatgtggtgaatctgggcataggcggttccgacctggggccgcgggtggtgcaggagggcttggccgcctacgcgcatgccgaactcaatgtgcatttcgtgtccaatgtcgacggccagcacctggcgcgcacgctggcgcggctggatcccgccaccacgctgttcatcgtcgcctccaaatcgttcaccacgccggagacgctgctcaacgcccaggcggccaaggcctggtttctgcaggccggcagcgaggctgacatcgcgcgccatttcgtggcggtttccaccaacgagccggcggtgcgcgccttcggcatcgatccgcagcagatgttcggcttctgggactgggtgggcgggcgctattcggtgtggtccgccatcggcctgccggtgatgatggcggtgggttacgacaatttccgcgccttcctggacggcggccacgcgatggaccgccacttcttcgaggcgccgttctgcgccaacatgccggtgctgatggcgctgataggcatctggtacaacactttctaccaggcccatacccatgccatcatgccttacgaccacggcctgcgcagcctgccggcccatatccagcaactggacatggagtccaacggcaagcgggtggggcgtttcggcgaggcgctggatttcgacaccgggccggtgatctggggcgaggagggcgccaatagccagcacgctttcttccagctgctgcatcagggcacccgcttggtgccgtgcgacttcatcctgccgctgaacagccactatccggtcgccaaccagcacgaggtgctggtggccaactgcctggcgcagaccgaggcgctgatgcgcggcaaggccgaagccgaagtgatgcaggaactgagccacttgtccggcgaagaactggacatgctgctgccgcagaagctgttccccggcaatcagccgtccaacacgctggcgctggaccggctgacgccgtacagcatgggcatgctgatggcgctgtacgagcacaaggtcttcgtgcagggcgtgatctggggcatcaattccttcgatcaatggggcgtcgaatacggcaagcagctggcgcggcgcattttgcccgagttgtcgggcgcagccgccgagctgtcgcatgacagctccaccaacgggctggtcaaacatttcagggaacgtcatggcagatagcaaacagttggcggtcgatctggggctgctgttgtcggcgcgcggcgagagcgtggctaccgccgagtcgtgcaccggcggcttgatcgccgcggcgctgaccgatgtgcccggcagctccgcctggttcagccacggcatcgtcagctacggcaaccaggccaagcagcaattgctaggcgtgcaggccgcgtcgctgatcgaccatggcgcggtcagcgaaacggtggtgcgggagatggcgcagggcggccagacgctggcggattcggactgggcggtggcggtgtccggcatcgccgggccgggcggcggctcgccggaaaagccggtgggcctggtctggttcgcgatcgcccatccgggtgggcagaccgaggcctggcgctgcctgttcgccggcgatcgcgaggcggtcaggcggcaggcggtatgcgaggccctgtcgcagctggaaaagcgtgtccgcagccatgtccatctggcgtgacggcggggggctgggcgggcgcggcagcctgccggtccgattcaggattttgcatatgggtagcgaatggagttttacgcatttccggcgatagccttgttgttcgtcggcatcttcacccgcgaggtgatcgcgccggcctcccgcaatacctgcgaccggcgctggctggcgttggcgtcgattctgggcgcggccacggcggcggtgacgctggctgtcggttttcttttcgccggcttgatccgtgaagtttcgctgatcccggcggcgcgcggctggccggacatcgcagtcggcgcggccagtttcctgctgaccagtttcgtcttctattggtggcaccgggcgacgcacgcttccgactggctgtggcgggtgtttcaccagctgcatcacagcccgaagcgggtggaggcgttgaccgcgctctacgcccatccgctggattccgcggcggcggtgctgatcagcgcgttttccagctatctggtgttgggcgcgacgccagcggcagccgcctgggcgctattcttcaccagcgtgttcgatctgttcctgcacagcgacctgaaaacgccgcgttggctgggatatctgttccagcggcccgaaatgcacactgtgcaccatgcctacggccaccatgcccaaaactacggcctgccggtttgggacttgctgttcggcacctggagcaatccggcggagcgggtggcgcggctgggtttcgatgacgataaggcggagcgggtgcgccacatgctgttgtttcgcgatgtccacaaaagcggcgctgacgacgccgaacgttgacgccgtcggcgctcagtcgtcgtcgggctgcacttttttgcgggccctggggtgggcgttgtcgtagaccttggccaggtgctggaagtccagcgcggtgtagatctgggtgctggacaggttggcgtggcccagcagttcctgcaccgcgcgcaggtcgcccgacgactgcagcatgtgcgaggcgaaggagtggcgcagcatgtgcgggtgcacgtgctgattggcgccggtcttgatcgcccagtcgcgcaggcggttttcgatctgccgtccgcccaatcgccgcccgtggcgggcggtgaatagcgcgctttcgccatcttgcgccaccctttgcgccagccacttgttcagccagctggccgcttcggcgcctatcggcgtcagccgcgtcttgttgcccttgccgcgcacgcgcagcagatggtcggcgaagtcgacgtcgtccagattcagcgccaccgcttcagataggcgcagtccgcaactatagatcaactcgaaaatggcgcggtcgcgcacttccagcgcgtcgtcgccgtcgatgcggtccagcagtgcggcggcgctgtccaccggcagggccttgggcagcaggcggtcgcgtttgggcgcgtgcaggctggcggcgggattgtcgtcgcgcaggccgttttgctgcagccagtgatagaactgccgccacgacgacagccggcgcgccagggtgcggctgcccaggccctgggcgtgcagcttggccagcgcccgcttcaattcgttgacgccggcggcggccagcggcgccggccgcagcatggcggccagcagattcaggtcggcccggtaggcggacagcgtgtgggcgctgcgcccggctatcgccagctggtcgatgaaatgccggatcgggtcgtccatgtcagttgcggcgtcgggccatctgcatcaggcgctcgaacagctgcagatcctgttcgtttttcagcagcgcgccggccagcggcggaggggcgttgcgcgcatggcggttttccagctcgtcggcgccgatgttttcgccgcacagcagcttcagccagtccagcagttcggaggtggtaggctttttcttcaggcccggcagctcgcggatggagaagaacacttccagcgcctgcttgaccaactgctggcggatgtcggggaagtgcacgtcgatgatggactgcatggtgtcggcgtcggggaagcggatgtaatggaagaagcagcggcgcaggaaggcgtccggcagctctttctcgttgttggaggtgatgatgatgatgggacgctggcgcgcgcgcacgaactgctgggtttcatggacgaagaattccatctggtccagttcgcgcagcaggtcgttgggaaactcgatgtcggccttgtctatctcgtctatcagcagcaccggcgcctgttcggcctcgaaggcttgccacagcttgcccttgatgatgtagttggcgatgtcgtgcactttgtcgccgcccagctgggagtcgcgcagccgcgacaccgcgtcgtattcgtacaggccgtgctgggccttggtggtggatttgatcggccagacgatcagctcccggcccaggctggcggcgacctcttcagccagcatggtcttgccggtgccgggttcgcccttgatcaacagcgggcgttgcagggcgatggaggcattgacggccatcatcagatcgtcggtggcgatatagcgttcggtgccggtgaagcgcgtgttcattgtcggtttcggtatcttgggtggtggaatgcaaaaagcagccgcggggactgtgcgccgcggctgcttccatttttgggctcagcgggcgaattcgcgctcgagatcgtcgagagagatgccccagcttttcatcatgtagctgagcagagccatttcgctgtcgctgatggtgccgtccgacttgctgatgtccatggccagcacgcaggtcaggatgcgcttgcggtggtcgctgacttcggacagcaggttgtcgattctttcgcggtccagcaggcggatcgcgccatcgtcgccggcttcgtccgacacatcgtcgcagaagtcgcgcaatacctgggcgaactgtttgcgcggcaggttgatcaggtggtagacatgcagcttttccagcagctcaagctcgcgcgggtccatattgccgtcggtgatcatgaacatggccaggagtctggccagcgcctctgggctgttgggcgggtagtttctcatggcgccattccttttttctattggctgagcttgccggaaaacgcttccggcatgggggcgactttgcgtgcctggtagtcgaaaaagacgatacctgtcttcaatcttgccacttctttgccagtgttgtcatcgactgcttgataaatgaggtcgaggccgtggcggccgatatccgcgacgccgatgcggaagcgcagccggtcgccgtggaaggcctcggcgcggtagcaggcggcgacgtcggcgatgacgatgccggctccctccaccgccagttcgctggcgtagcccagctgtttgaacaggcgcagcctggcttcctgggccagtctgagcagcgcgtcgttgccaagatgtccggcgtagttgatgtcgccgatgcggacttccagcgcggtgtcgaaaatgaagcggggcggcagttctatctggatgcgggccatggcgggatcctgcggaggtgggctgtgtggcggatatggcctttatgtcaaaggaagctaatctgtgtcaaacggtaccggcaagggtttgatagactgaaggtgtaggccaaactcgtagaggagctgagcgtcatgtatcagagaatctttgtgcctgtcgacgatagcgacacttccaatatggcgctgaacgaggcgtgcaagctggcgaaggagttcgggtcgtcgatcaggctggtccacgtggtggatctggcgcagttcggctggggcgggacggagtttctggacgccaccgaattgcaaaagtcgatcaagcaagccggcgagcaggtgttgggacaggccggcgagcgcgcgagggcgctgggcgtggagccggagtgcaaaatcctggagagctggggcgacaagatcgccgcggtgttgtccgacgacgccagcgtctggggcgcggatctcttggtgatgggcacccatggtctgggcggcctgatgcacctgctgatgggcagcgtggctgaaggcgtgctgaaggtggccgacatgccggtgctgctgatccgcaaccctggcgattagtcagcaggcatgggcggcggcgcctgtcggcgattgttcgacattcggaatgtgaaaaagccagcgcggcggaggccgggctggcttttttgtcggaccggatatcagccggcggtggcttcggcgccgccttcctgagcttcgatcttggtgcgaaccgctttgcgcaggctcttgtacagatcggggtgggtctctttcaggtactcgacgatctcgaagtcttcgcggcgtaccttggacaggtcgatctgctcgacatgcaccaggcgcagcagttcgcgcaccggcttgggcatgttgcggccgctttcgtagcgggagccgccggattgggtgacgccgatgcggctccagaattcttgctggttcaggccaagcttgcggcggatttcccgagggttcgggattttttcaaacagtttcatgagtgttcctctcgtatctgaacaaatggttctagtatttttttaggacttcgccctgcttactaaaaatagcaaaaaaaattcaacaggaatatttatgatgcagggaaattagtgaagttccatgaatttgaaaattcaactttgctaatgttagcggaatcttatcgtcaaggacaatgggatttgatggcgacgtcgtaatttggctgaaaaagtgtcgcaaatctgcaattgagcttggcggaactaaagaggggaggggtggcgagcctgacccccggcacttgcactaaataactgtggctgcttccttccggacctgaccaggttcgctatcgtgcaatgcggggaggcccgccatagagaaaacggattgtatccaaagccgtgctagttgccaagcattttttatgcagcgctttgcctccccgccgccgagcatgatgaggagggcggccgctattgcctgccggccacgccgggtgcagactctggaacagactcaatagccaagcgcaggattgtctcatgcctacagacgcatccggattgctgtccgaactgatccgcttcgataccaccagccgttattccaatctgcagctgatagagtgggtgcgggaatatctggccggcttcggcctgacaagccgcctgacttataatgatgatggcagcaaggccaatttgttcgcgcgcatcggcgccgaggacctgcctttgatcgtgctgtccggccacaccgacgtggtgccggtggatgggcaggattggcattatccgccgtttgagctgaccgccggcggcgatggccgcttgtacggccgcggcagcgccgacatgaaaggcttcatcgcctgcgtgctggcccgagtgccggatttcgtcaggctggccgccgaaggcaagctggcgcagggcataggcatcgcgctgtcctacgacgaggaggtgggctgcctgggcgtggggcgcatgatagacgcgttgatcgccgatggcgtggatgtcgccggctgcctggtgggagagccgacgtcgatgaagccggtgatcgcgcacaagggcatcgcccactatcgctgcgtggtcaagggaagagcggcgcattcgtcgctgacgccgcatggcgtcaacgccatcgagttcgccgcccgcctgatcacccatatccgcaagctggcagatgccgaggccgcgtttggccaccggcagccgctgtacgacgtgccgttcaccaccatgcagactggtttggtgcgcggcggcgtcgcctgcaatatcgtgccggccgattgcgagttcatgttcgagtgccgctggttgccgggcgacgacccgcagcggttggtggcatcggtcgccgactacgccgccaccttggagcaggaaatgcaggcggtggccggcgaggcgcagattcgcatcgagccggtggtatacagccccgctttcgagtccgacccgtcgtcgtccatccggcgctacgtcgtcagcctgtgcggctgcgaaggcggcgccggcgtcgcctacaccaccgaagcgggtctgttcagccaggccggcatgccttgcgtggtgctggggccgggctcgatcgagcaggcgcaccggccggacgagtttatcgaggtggcgcagttgcaggcctgctatgattggttgggcaggctggcggacgagttgatccagcccagatagctgtaaaaattgttttgcacacatacaaaataggcttcacaatccacgccctgtagcatcgaaggtcatgtgagcccgcccggacgacctccgcgcgggctcgtttcatttgtggtggtagagagaacaacaatgagtgtggacaaatccaaatcgggtggagaggtcaagctgagggatggattcacgtccagcttcggcgtgctggcggcgacgctgggctcggcggtaggcctgggcaatatctggaagttcccgtatctgaccggcaccaatggcggcgccggttttctggtggtgtacgtgctggccacgctgctggtgggactgccggtgatgatctccgagatcatgctgggccgcaaggccaagcgcgatgcggtgaccacgttggccaaactggcgccggccgggcagccgtggtggctggtgggcgctttcggcgtgtttgccgccttcctgatcatggctttctattccgaggttgccgcctgggtgttcgcctatattttcaaggcgatcgccggcgatatcctgtccaacgatcccaaggtgacgtccggcgccttcaccgcgctgatcacgaatccggttcagtcgctgctgtggcaatggctggttctgggcctgatcggcggcattctgctgatgggcgtgtcgaaggggatcgaagcggtcaccaagaagctgatgccgctgctgttcgcgctgctgctggtgataggcgcgcgcagcctgatgttgccgggggcaagccagggcctggctttcctgttcaccccggacttctccaagatcaccgccggcgtggtgctgaccgcggtgggtctggctttcttcaagctgtccatcggcatgggcaccatgatcacctacggcagctacttccgcgacgatcaagacgtgccgctgaccaccttccgggtgatgtgcgcggatctgttcgtgtcgctgctggccggcatcgccatcttcccggcggtgttcgccttcggcttccagcctgccgctggtccgtcgctgctgttcatcaccattccagcggtgttcgccagcatgccgctgggacatctgttcatggtggtgttcttcgtgttggccgccatagccgccaccggcgcgatgctgtctatcctggaggtgccggtgtcggtggtgagcgagcgcttcggcatcagccgcgtcaaatccaccatcatcaatctgttgctgttggcgttggtgggcgcgggctgcgcgctgtccaacagcctgaccgccgatatcaaactgcacggcatgacgatgttcgacctgttcgacttcgtcacgtccaatgtgctgatgccgctgggcgggatctgcctgtgcctgttcaccggctgggtgtggggctacgaccgcttccgcgacgcgctgagcaatggcggcgcgctgaataacgcgcgtctgctgaaggcgctgttcttcgtggtgcgcttcgtgtcgccggtgctgatcctggtggtgatgctgaagggcttgaaggtgatttgaggcggttttgccatgcccggcagcgcgtgcgcgccgggcatggcgctcaggaaggcgtgccgtcttcgtcgccgctgactaccggcggcgcaacgaagccgttgatgtcgcgggcgcttttttccagcagcaggacgatggcggtattggccgcgccgaacagccagctggccagcaggaacaccgaataggctgtgagcttgtcggcgaatagggcgttgccgtgcaaggtcagttcggcggggtcgaaaatcgagtaaaaaacggcggtggccgccaccgcgatgatgaaagacggccagaacagcaggattccctttttcatgaaaagcctccgaatatcggcctcggcgccggcgcggagcgtccgggcgcgatggccatacttctgcttatgtcatcgggccggctttgtcgatgccgcgcatgcggccctgcccgtggggacaggcaatccgttgtggggcgatcggcatccgccatgttagactgttgttcggctgcgaacttatttgcgttcgaatggcaacaagcaagactggattttctttggccggctctggcagccggctcatctgcaaagcaatggagcctggtatgacctcttcgatcttcgccggtgtggaactggcgccgcgtgaccccattctcggtctcaacgaagcattcaatgcggacgcccgcgataccaaggtcaaccttggcgtcggcgtgtattccgacgacaacggcaagattccgctgctgggcgcggtcaaggccgccgagaaagccaggctggaagcgctgccggcgcgcggctatcagcctatcgaaggtccggcggcttacgacaaggcagtgcagaacctgctgttcggccaggatggcgagctgctcgccgccggccgcgtggtgaccgcgcaggccttgggcggtaccggcgcgttgaagatcggggcggatttcctcaagcggctgaatccggcgtccaaggtgtacatcagcgacccgtcctgggaaaaccaccgcgcgctgttcgaatcggccggtttccaggtggaaaattacccttattatgaggcggccagccgcggcgtggatttcgccgcgatgaagtcgcatctggcggcgctggacgcgggttcggtcatcgtgctgcacgcctgctgccacaaccccaccggggcggacatgtccgcggcccaatgggacgaggtagtggcggtttgccgcgagcgcggcctggtgccgttcctggacatggcttaccaaggctttgccgatggcatcgaagccgatgcgctggcggtgcgcctgtttgccgcctccggcatgcagttcctggtagccagctccttctccaagagcttctcgctgtacggcgagcgcgtgggcgcgctatcgatcgtgacggcaggcaaggacgagtccgcccgggtgctgtcgcagctgaagcgagtgatccgcaccaactactccaatccgccgatccatggcgcggccatcgtcgccgcggtgctgtccagcccggaactgcgccagcagtgggaagacgagctggcgggcatgcgcgatcgcatccgcgcgatgcgcctgcggctgctggcggcgatcaaggcgcatggcgccgcggttgacttctccttcgtcaccgctcagcgcggcatgttctcctataccggcctgagcgctgctcaggtggagcggctgcgcgctgagttcggcatctacgcggtgtccaccgggcggatttgcctggcggcgctcaatagcaagaatgtcgattacgtggcggcggcaatcgccgcggtgatccgcgattgatgagtttttgactcgcgcgcaaggcctcggaaacgctccggggccttattttttggggtgcgcgatgcagcggaaaagtagttcaaatgcggatttgtcatgaattgaaatgtcaatggcatttgctgttcgcggctgtgacatccaggcgaaagattgggtggccaaaaggacagttttgatctagcggctgcgatattttcctgagatggcattgtctgcgtcggtaaatatcctcatgatgcgtgaagacatcagtgaatgtcaggttgcaaaccgtcagcttcggcgacggcgcaatacaaaataatccaacagcttgttagaggggaaaccctcggggtagatgccatgactgcgacttttcctgaagtgctggttccgcaggccataactgcgggtgcttttgacgcggatgatgccgatgtccgcaataaccttggcctccttggcctgcttgatgtttattcccgcgacggcagctatcggctgaccgtttcgctggagccggtggatccggacaggcagcccagcttgtgggcgctggaagtggagatggaagtgtgcgccgacggcaaggtcgcgcgccgcgccgggcagcagctggagtattccggttcgacccctggcagccatctgcgcaagttgctggccagcggcgagctgcacggctacttgctgcaggggacggccgccgcggcttgatctggtttgagctgaaacaaaaaagccactatcgcgagtggcttttttgcgtccatggatgggcatgtcagacggcgtgtctctcgtacagcgagcggaaggcgtgcatgtattccggctgcacatagggcttgagcagcgccagcacctgcagcacgccgcggtggccggactcctcggtgatcggcgccttggggcgggaggtctgctcgaaagcgaaccagaatttcaccaccagccagatgttgatgctgacgccctcgatgtcctcttcgtccatcttcagcagtcccaggcggatgaattcgcggaaatgctcgccgaggatgtttttcagctcggtgttgacgaactggtggtactccgactgcatctgcggattgcgcgccagcatgccgggcaggtcgtagaacatgaagcggaactgccacatcgccaggaaggcggtgtccagatagttgaccagatcgtccaccgtcatcttgcggtcttccggcaccgccagtcgctggttgatgaactcgcgatacatggtgaatatctggtagacgatctcttccttgttgcggaagtgatagtagagattgcccgggctgatgccgaggtgcgcggcgatgtggttggtggtgatgctgcgctcgccctgttcgttgaacagcttgaggctctcctgaatgatgcggtcgtaggtcttgattctggttttactcatgatgcaccggctggtaatgacttcgcatagcgcaattgtatacgatgtttggagttctagctctattttttacgattggacgacagggtaacagtcggccaggaattgatgcaggatggcttgctcgatacgttgccgctcccgcgccggaatggcgatgcgcaggatcaactggtagcgcttttcgtcgaccggctggatggaaatgcgcggctccaccgatggaatgtcgaccagatagcgtttggccatgtcctccatgtggcggcgcgccacgtccacgtgcggcaggcaggcgctttccgccgcgctcatcagcatctgctcggcgcgggcgggcggcacttcataggccagcggcacgttgacgatatgcatcacgtactcgcccatgtagttttcgcgtatcaccggggtggacagcagcaggctgttgggaaaggtcagcgcccggcccgtcatctggtgcgagctgtggttggggccgatttccatcacggtggtggacaagaggccgatgtccaccacgcggccgcgaacggctccgatctcgacgtgatcgcccaggctgtagctgttcgacatctgccgcaccacgccgccggacaagcacatgatcagctccttggtggccaggatcagggcggcggcgaatgccagcatggagacggccagcgtctgcagctcgttggcccagatgaagcctatgcccgccaggccggtgagaaacaggccgttgcgggtgttgatcgaccagcggcggcgctcctcgaccggcacgccgctgttggctgccagcagccggtccaccaccacgcggatgatcagcagggtcaggatcaacagcagcgagcgggtgatttcatgcgagtagttttcccgcaggaaggcgaccaggtcgaggagggtgtgcatgggctcagtcgttcagcttgaccgcgtgctcgcgggtttcgtggaagacgatgtccggccagcgttcctgcgtcagctgcaggttgacgcggttgggcgccaggtaggccagattgccgccggcgtcggtggcgatgttcatctgcagcgatttgacgaaatcgtccagcttcttgcggtcgtcgcaggtgaaccagcgtgccgaccagatgctggcggattcgaagatggcgtcgacgccgtattcggcggccaggcggctggccaccacttcgaactgcagcacgcccaccgcgcccaggatcagatcgccgccgctatgcggcttgaatacttgcaccgcgccttcttcgcccagttgttgcaggcctttttgcagttgcttcagcttcagcgggttcttgatgcgcaccgagcggaacatttccggcgcgaagaagggaatgccggtgaaggccagctcttcgccttcggagaagctgtcgccgatctggatgttgccgtggttggggatgccgatgatgtcgccggcgtaggcctcttccacgatttcgcggtcgtgcgacatgaaagtcaccaccgaggaggcggcgatgtcgcggttcagccgcagatgcttcattttcatcccgcgctcgaactggccggagcacacgcgcaggaaggcgatgcggtcgcggtgcttcgggtccatattggcctggatcttgaacacgaagccggagaatttgccctctttcgggtccacgctgcgaacggtggcgtcgcgctcttgcggcgccggcgcccagtcgatcagcgcgttgaggatttcgcgcacgccgaagttgttgatcgccgagccgaaaaacaccggagtgagggtgccggccaggaattcgtccaggctccactcattggaggcgcccttgaccagctcgatctccatgcgcagctgttccatttccaacgggaacagttcgtccaggcgcgggttgtctatgccctggatcacctcgatgtcggataccagcttctccgcgccggcctcgaacaggatcaccgcgtcgttcagcaggctgtatacgccgcggaaggtcttgcccatgccgatcggccaggtgatcggcgagcagcggatcttcagcacgtcttccacttcgtccagcaattccaggctgtcgcgcacttcgcggtcgcacttgttcatgaaggtgacgatgggggtgttgcgcaggcggcagacgttcaacagcttgatggtctgctcttccacgcccttggcggcgtcgatcaccatcagcgcgctgtccaccgcggtcagcacgcggtaggtgtcttcggagaagtcctggtgccccggggtgtccagcaggttgacggtgtgatcgcggtagtcgaactgcatcaccgaagaagccaccgaaatgccgcgctgcttctcgatctccatccagtcggaagtagcgaacttgccgcctttcttgcccttgaccgtgccggccatctggatggcgccggagaacagcagcagcttttccgtcagcgtggttttaccggcgtcggggtgggagatgatggcgaaggtgcggcgatgcgagacttcttcggcaatgcgggacagttcggcggacatgggcggcttgcttgaaattcaataaagccgggtattttaccggacttgggggcttgaggaagttttatgttaatatttgagaacgattatcaattacaaaaatttccgtgatgcaaccaagaagcgccgcagtacaccctggctctccctcaatctttccattttgcttgtccgcgatcgcctttggcctggctagccacgccgccctggcagcggagcagtccacgctcgagaccgtcaaagtcagcgccgaagcgctggtcttgaggccggcggccagcaagctcgcgcaagaggaaatcgcccgcccgcaggcgaaatcgctggccgaggtgctggatgcgttgcctggcgtcaacgccggcggctcgccgcgtcccggcggacaaaccatcaacgtctggggctttggcgacgtggagcaagtgcaagtgtatctggacggagccgggcagggcttcgacaaataccagcagggcacctctttcgtcgatccggagctgctgggctcggtggaggtgatcaagggcggccattcgccgttttacggcaacggcgccttcggcggcgtggtgaaggcggaaaccaagaccgtcaatgaactgctgttgccggggcgcagcgtgggcggcttcgccaagctgggctatcaggataatggccaccgcttcagccagtcgctggcggcgtatgccggcggcgccggccagccagccgacatcctggcctatgtcacgcacagcaagggaggcgacggcacgcagccggacggcacgccttaccgcttctccggcggcgagcagcaaggcggcatgctgaagctgggctggcggcccgccgacggccatagcctgaaactcggttttgtgcgccaggacgacgagctgcgcacgccgtgggcggcccggcgcggcgacatcccggcgcccagcgcttacgatatcgccaagtacggcctggaggaggcctggctgcgcaaaaccgtgtggcgcgagcagacggtggagtcgatgaccgccgactggagctatgtcagcagcgatctgccctggctggatctgcggctcagctacgcgcagtcgcggcgcttccagcatgacacccggccggacggggtgaacagctcggccttcgattcgcagttcggcaaggaaagctgggtcagccagcgcgataaacagtgggagctgcgcaatgtggccaacctgggcgaaggctggtccagccagcaggtgacggtcggcgtcgcctggtcgcgcaaggatcgcgacgccatcgcctacatgccgagcaaggccagggatcccagttacaactacgggctgatgaacccgcgctattcgccgccgggcagcgaaaccatgcagtcggcctactgggtgcacgaatggaggccgctggacggcttcagcctgacgccgtcgctgcgttacgaccatatcgaggtgcgcggcaggcagaacctggcgcccacctacaacaatccggccaagggccacgactacagcgcgctggcgttcgccggctggtcgccgcggctggccgccagttggcgtttcctgccgcgctggacgctggacgccggctatgcccacacttggcgcgcgccgaacgccgatgaagtttacgacgtgcagacgctgggcagcaccaccgccagcagccgccagctgcggccggaaaagctgaaagcgctgaagttgggcctggcttacgacggcggcggcgtgctggccgcgggcgacaagctgtcggccagcctcgcctggttccgccaggatgtcaccgacgccatcggccagcgcatcggcccgaaccgcggcgacgcgcccggcgcgccgctgccggcggtgatcggtttttaccgcaacctgccgggttatgtgattcgcggtttcgaattcgacagccgctaccagtggcgcggcgctttcgccagtttgtctttgtcctccgtcgtcggcgagcgccgccacagcttgcgcgacccgtggggcaaggacgagccgatggtggacatcccgccgcgcaaggcggtgctgaccgccggctataccttcgcgccggcggggctgacgctgggcgcgcagggcaagttcgtccgcgcgcaggaccgggtgccgcaaaacgtcaacccggaggccgtcggctacgcctatccggcccagcatggttacgcgctggccgggttgttcgcggtgtggcagccggcgacggccgggctgaagggcatggaggtgaggctggcggtggacaatctgttcaaccgcagctaccagccttacctgaccgaaggcgcggaaggcatggggcgcgccatccgcagcagcgtgtcctggcgtttctgagcgcatcgcgcaatcttcgcaaaccggccccaggccggtttttttatggcggcggcggattggaaaacggccagtcggctacaatatcgtccaaacgacaattcaaaccaaggaggcttgccgtgttcaccggtatcgtccagggcgtggccgaagtggtcgccatcgaggaaaaacaggatttccgcactcatatcgtccgcttgccgcaggcgatgctgcccggcctgcagcttggcgcctccgtcgcccataacggctgttgtctgaccgtcacccaagtcgacggcgatcgggtgcatttcgacctgatgcgcgagacgctgcgcatcaccaatctgggcgagctcaagaccggcgacgcggtcaacgtcgagcgcgccgcgcgcttcggcgacgacatcggcggccacgcgatgtccggccacgtgatgggcctggctgaggtcgtcgaggtgatcgaatcccccaataaccgcacaatctggttcgagttgcccgccgggctggaaaaatacgtgttcgccaaaggctatatcggcatagacggcatcagcctcaccgtgggcgcggtggaggggcggcgcttctgcgtgcacctgattcctgaaacgctgacgcgcaccaatatcgccgcccgccggcccggcgcgcgcatcaatatcgagatagacccgcaaacccaggccatcgtcgacactgtcgagcgggtgctggcgcagcgcggccaggcatgattttgcgggatttgccggtggtggcgtcgtggagcggcggcaaggacagctgcctcgcgctgtggcgcgcggtccaggccggcgccaggccgcaggcgctgctgaccatgctggacgagacgggcgagcgctcccgctcgcacggggcgcggcccgaggtgctggcgttgcaggccgatgcgctgggcttgccgcagcggttggggcgcgcgagctggaatgattaccgcgaggtgttcgtcgagcggctgcgggccgccgcggcggacggcgcgcgcgcggtggtgttcggcgacatcgacctcgccgcgcatcgcgaatgggaagagggcgtctgcgccgaggcgggccttgaagcgatcctgcccttgtggcagcaagcccgcgccgatctggtgcgggaattcgtcgcggcgggcttcgtcgcccgcatcgtgatggtcaatgccgcgctggcggacgagaagtggctggggcggattgtcgacgcccggctgattgcagagatgctggccgaaggggtggatccctgcggcgaggcgggagagtttcataccctggtggtggacgggccgctgttcgcccggccgctggcgctgcgcgacggcgcggtcgcccatctgggcgactatcgcgccctggatttattgcccgcgtgagacgggcagactgaacaaaggaagaagcatggccatttctccgattcaagacatcatcgccgacattaaggccggcaagatggtggtgctgatggatgccgaagaccgcgagaacgagggcgacctggtgatggcggccgaattcgtcacgccggaggcgatcaatttcatggccaagcacggccgcggcctgatttgcctgacgctgagcgaagagcgttgcaagctgctgaacctgccgatgatggcgaccaacaacggcaccagcttcggcaccaacttcaccgtatcggtggaggccgctgagggcgtgaccaccggcatttccgccgctgaccgcgcccataccatccagaccgcggtggcgaggctggccaaggccagcgacttggtgcagcccggccacgtgtttccgctgaaggcgcagaacggcggcgtgctgatccgcgccggccataccgaggccggctgcgacctggcgatgctggccggcgtggagccggccggcgtgatctgcgagatcatgaacgacgacggcaccatggcgcgcttgccggagctgatcgagttcgccaagcagcacggtttgaagataggcaccatcgccgacttgatccagtaccgcagccgcaccgagtcgctggtggaaaaggtgggcgagcgtccggtggagacgccgttcggcagcttcgacctgcatgtgttccgcgacatcaccacctccgccacccatctggcgctgagcaaaggcaagatccgcgccgacaaggaaaccctggtgcgcgtgcacgagccgctgtcggtgatagacgtgctggcgccgctgtgcagccaccacagctggaccgtgcccaacgcgctggaaaccatggaggagaccggcggcggcgtgatgatcctgctgtatcgcgatgaaaccggccaggatctggccgagcgtgcgctgggtcaggaggcggcgcggcagaagtgggacagcaagactttcggcatcggcgcgcaaatgctcaaggcgctgggcgtgggcaagatgaaactgatgtccagcccggtgagcctgccgtcgatggccggcttcgagctggaagtcaccggcttctgccagcccggacattttcacgtggatggccagggcggcccaggcgtggcctaaatgcggcaattacgttacaattgccggctttccttagtgttttcgccgcgaggacaaaccaatgcttgatgcaatccagtgtattgaacccaatttttccggcaagggcctgaaagtcggcatcgtgatggcgcgtttcaacacgccggtgtgccatggcctgcgcgacgcttgtctcgccgagctggagaagctgggcgtggccgctggcgacatcaccctggccaccgtgccgggtgcgctggaagttccgctggtgctgcaaaccatggcccagaccgagcgctttgacgcgctggtggccctgggcgcggtgatccgcggcgaaacctatcatttcgagctggtatcgaacgaatccggcgccggcgtcacccgcgtcggcctggacttcgatattccggtagccaatgccattctcaccaccgagaacgacgagcaggcggaagtccgcatgcaggagaagggggcggacgccgctcgcgtcgcggtggaaatggccaatctgcacaagacgctgcgcggctgaattcccgccgccagccatccgtgggaagcggtcgccgcgcgcgccgcttcccttgctcttttgaggaatcgccaccatgaaaaccgcccgccgccgcgcccgcgaattcgccgtacaaggcatttacgagtgggaactgaaccaggaccgcccggcctcgctgatcgagaagcatctgcgcgagaacgaatacttcgccaaggccgatgaggcgctgttccgcaacatcctgtacggcgtactgaaggatgtgtccacgctgtccgcccagatcggccgctactacgagcgcgccgaggacgaagtcagcccggtggagcgcgccgtgctgctgatggccgcgctggaactgacgcaaagcccggaaaccccgtatccggtcatcatcaacgaagccatcgagatcaccaaaacctttggcggcaccgatggtcacaaattcgtcaacggcgtgctggacaagctggccgccgacgttcgcggcgacgaagtcctggcgcagaaacagcgccgcaagcaggattgatcgttccgcccgcccttgggtcggccggaatccacgacacccgctgctggcgggtgtttttgcgtgaggggtcatgaacgagttcgaactgatagcccgccatttccagcgtccggcgccgtcggcgctgctgggcgtcggcgacgacgccgccatcgtgcggccgacgcccggctgcgacctgcacatgtcggtggacatgctggtcgaggggcggcatttcttcgccgacgtggcgccgcgcgcgctgggccacaagacgctggcggtgaacctgtcggacatggcggcgatgggcgcgcgggcgcgctgggcgctgctgtccatcgcgctgccgaaggcggatgaggcctgggtggcggaattcgccgccggctttcacgcgctggcgctcgaacatggcgtggagctgataggcggcgacaccacttgcggtccgttgacgctgtcggtgaccgtgctgggcgaggcgccgtccgggcaggcgctgcgccgcgacgccgcgcggcccggcgacgatgtctgggtgtccggcgagctgggcctgggcgcgctggcggtgcgccagcgcctgggctggctgacggtggacgacgcggatctgctgcaaacggcgcggcagaggctggaatacccgcagccgaggctggcgctgggccgcctgctgttgcctgtcgcccatgcggcggcggacgtgtccgacggcctgatggccgacctgggccacatcctggctgcctccggcgtggcggccgaaatccaggccgacgccttgccgtccgatccccggctggaggcgctgcgcgcgcggcatctcgactgcctggctgccggcggcgacgattacgaactggtgttcaccgcgccgccgcaacggcgcgcgcaggtggaggccgccggcgcgcaatgcgcttgccgggtctcccgcatcggccgcatcgtcgaaggcagcggcggcaagcttttggacgccgccggccacccgatccctttacagaaagaaggctatgaccacttcggctgataccccgctcatcgttcccaattggcgtttcctgttgagccaccccgcccatctgctgtctttcggcttcggcagcggcctgatgaagaaagctcccggcacctggggcacgctggtggcctatcccttgttcttcccgctgctggcgctgggggtggacggctggtggctgatggccttgtgcgcgccgctgttcgcgctgggagtgtacgtgtgcggcatcaccggcaaggcgctgggcgtgcacgactacggcggcatcgtctgggacgaggtggtgggcatgctgatggtgctggctttcgcgccggctagttggcagggctggctgctggccttcgcgctgtttcgcttgttcgacatcgtcaagccctggccgatccgttggttcgaccagcgcgtcggcggcggcttcggggtgatggtggatgacgtcatcgccgcgctgttcgcgctggcggcgcagtggctgatctggcgcgccttgtaaacagcgggaatctaatccccggcgatgtatcaaagccgttacaattcggcaataacagcaggtggcggcgctggccggggtcgcggcgccgccatgactaaaaacatgcccagccaggatgcgggcagcttgaaatcggggttttgattgtgtgggtcgtagtgtttctgttgctgctgctggctgcggccggctggctggtgaaaaccggcaagatatcgttgccatcgttgacgagcaaactggacgggctgctgggggtggaaggccggcctgagcgttacgagccggactacttcgccgagccgcgcgagacgcctcccgcgcccgaggccgaagcggcaatggccgcgcgcagcgaagactcggtagacgcgcctgaaatcgaaacggttccgccgcagcccgaaccgccgcaagcccaggccgtgcggccagaaatccgcctgccgcgccgcgtcgcgccgccgccggaagcgccgcgcgagaccatcgtgctgccgcgtcgcccggagccgccggcgcgcgaagcgcccgtcgagctgcccaagcttgagctatcgcgcgaataccgcaagaaaacccgcctgccgccccggtcgcgggaggacgagctgccggtcatcggcctgtcggaaatgcaaagcaatatgcggcaggattttcgccgccgccagcgcgccagcggcgtggcaatgccggcaggcgagggcgagctgccggtgataggcagccatgaggtgagggagaaggtcgccagcctgcatgcccatcgccgcgcagcgcctcctgttcagccgtcgttgcccaaggtggagctggcgcccatcgttcgcgccaatttaccgccggcgggcaaacccgcgcccgcattccgcccccccgaggcggtcgcgcatccgcaagccgcggccatgattcggcctgccgccgcgccggcgatgcctgcggcggaaacggcggcgcgtccggtcgcaatgccagtcgaagcggccgagccgcctgcggcggcggcgcctatcccgccttcagagccgcttgcggcggcagctgaatccatttccgcgatggccccgcagccatggccggtactcgacagcgagacggcggcgatggccgcgtccgcgccggatgagcccgagcagacgacaactgagctgacgcgcgaggcggcgcctgtcgcggcggccgagccggcggcgcagaccgcgccggaatggcaagccgccgccgaagcggaagccgggtttgacgcggaaaccgaggttgagacagcggccgcggatgacgagcccgcgcaagccgcccgcacgccttggcgctggccgcaaacccgcgaagtgctggtgcagcaggaaaacgccaggccggccatcgtgcagcaaaccgtgctgcagagcgaagccctggccgcgccgtctctggccgccaccaccgacaagctggccgccaatcccatgccttgggtgctgatagacaaggcagccgatgcgccgccgcctgagcctagcctgcaggccgcggatgccgaagcgtccgagtcaacagccgaggcgccggcctggacggagcgcgccgcttacgacgactccatcctgccgggcttggagctgctgcgtcccgccgatgccgtcaccgtggcctgcagccaggatgagctgctggagcgcggcatcgtcatcgaagagaagtgcgccgaattcaaggtcaaggtcagcgtggtggatgcttatgccggcccggtgatcacccgttacgaggtggagccggcggtgggcgtgcgcggcaaccaggtggtgaacctgatgaaggacctgtcgcgcgcgcttggcctggcgtccatccgcgtggtggagaccattccgggcaaaacctgcatgggcctggagctgcccaaccccaagcggcagatgatacggctgtcggaaatcttcgccgccgatgtgttccagcagccggcctcgcggctgacgctggcgctgggcaaggacatcaccggcgagccggtgacgatggacctggccaaggcgccgcacctgctggtggccggcaccaccggctccggcaagtcggtgggcgtcaacgcgatgattctatcgatgttgtataaagccacgccggacgaagtgcgcttcatcatgatcgatcccaaaatgctggagttgtcggtctacaacgatattccccacttgctggcgccggtggtcacagacatgaagctggccgccaacgcgctgaactggtgcgtcggcgagatggagcgccgctaccggctgatgagctcgctgggcgtgcgcaatctggccggctacaaccagaaggtgcgcgaggcggccgaacaaggccagcgtatttcaaacccgttcagcctgactccggaaacgccggagccgctcgacaagctgcctttcatcgtggtggtggtggacgagttcgccgatctgatgatggtggccggcaagaagatcgaagagctgatcgcccgcctggcgcaaaaggcgcgcgccgccggcatccacctgattctggccacccagcggccgtcggtggacgtgatcaccggcctgatcaaggcgaatatcccgacgcggatcgccttccaggtgtccagcaagatagacagccgcaccattctggatcagatgggcgcggaaagcctgctgggccagggcgatatgctgttcctgccgcccggcaccggctatccgcagcgggtgcacggcgccttcgtcaccgatgacgaggtgcacgcggtggtcgaacacctgaagcagttcggcgagccggactatgtggaaggcctgttgaccggcgagagcgaggcggacgaggcttcggccgacgccacggccaaggcgcaggcggcgacagagtccgaccccttgtacgacgaggcagtggagatcgtgctgcgcacccgcaagccatccatctccggcgtgcagcgccatctgcgcataggctacaaccgcgccgcgcgtttgatcgaagagatggaagcggcgggcatcgtcagcgcgatggaaagcaacggcaaccgcacggtgctggtgccgcagcgcgatttctagcgcgatcgcggccaatgaaaaaagcgcgccgcgaggcgcgcttttttcatgcttgcaaccggccagggcttagggccacagctggcagtattcggtgttggcttcgtagttgccgctgaccgagccgtcggcgttgatcttcttgacccagccattgggctggcggctggtcggcttgacgccgcagttgctatgcacccagtggatgcctacgccgctggtatagagttggccgcacagttgcaggcggtcgcctgcctggatggtgctcagcgggtagggcacgctctcgcctgcggtgtcgtagccggaggcgtatacattgtccatcgccacatcgtaggtgcggccgtcctggtcggcgcgcagacggacatgggtgtgggacagctccacgccgttcaggtcctggccggatgcgaactgcgggccggacaccacggtgccggtcaggtagctgccggcggcggcgcgacagtcggatttgccatcggccagcgcggcaaacgatacgcccagcaggcaggcggccattacgattgatttcatcagtttcacccttgcagttttagtttgatggttttaatgcaggggcaattctagtcaatcgggatattgcgtatgtttcggttttgagaataattatgttttttgtttgctcggcgttaacaagtgtgaattcacgcggccggcaatgaaaaaacgcgccgaagcgcgcttttgatcgtatggccagagccgttcagcggcggcgggacgcctcgtcgcggcgaatgcggatgggcaccagccggggctgctcttgttccggggtggccagcaatttggcgacagcgatgaccgcggcgacaagggcggcgaaaagaagaacttgcatggtatgactccccgtaacggatgaggcgtgtttcggatcagaattctggcctcttgcttcattctgggctacaacctgctccagactcaagggaaaagttatgtgccaacgttaaattttcaagcgcgggcggcagtttttttcaaatcccgcatcgcctggtccaggccgcccagcgtcatcggccgcatccgctgcgccatcaattgccgcagcatggccacagactgggtgtattgccaatgctcctcgcccagcgggttcaaccagaccgcgtgcttgaagtgtgccagcaggcgtttgagccaggtttcgcccgactcctcgttcatgtgctcgacgctgccgccgggataggcgatctcatatgggctcatgctggcgtcgccgacgaagatcagcttgtaatcgtcgccgaaggtgtggatcaggtcccaggtggaaaagcgttggctttggcggcggttgttgtccttccagaccgattcgtacacgcagttgtggaagtagaagtactccagatgcttgaattccgacttcaccgcggaaaacagctcttcgcaggcgcggatgtgatcgtccatcgagccgccgacgtcgaacagcaccagcaccttcacgctgttgcgcagctcgcgctgcatcctgagatccagcatgccggccttgcgcgcggtggcggcgatggtggcgtccaggtccagcacttcctcggcgccgtcgcgggcgaattcgcgcaggcggcgcagcgccagcttgatgttgcgggtacccagctccacctggtcgtcgaaattgcggaattcgcgctggtcccacaccttgaccgctcggcggtggcgcgactggttctggcctatccgtatgccttccggatggtagccgaaagcgccgaaggggctggtgccgcctgtgcctatccatttgttgccgccctgatggcgctccttttgctcctccagccgctggcgcagggtttccatcagcttgtcccagcctagcgcctgcagccggcgcttttcctcgtcgctcaggtatttctcagcctgcttgcgcagccattcctcggggatggcgcgctgcaggtcgtccagcgccatttccaagccgcggaagtgctggccgaacacctgatcgtagcggtcgaagtgcttttcgtccttgaccagcgcggttcgcgccagatagtagaaatcgtccaggctgccgaaggcgacatggagccgcaaggcttccagcagcgtgaggaattctttcagggtgaccggcagtccggcgttgcgcagcgcgtagaagaagtcgatgaacatgatggaccggcgaggtgacagcgggtttggcgggtgctaatcttgcctagagcccaggctctaaacatttgtttggctactactaaaaggataatactatggacgccatcaaaatgcccacccaagaggaaggctcgctgctcgaagcgttcggccggctcaagtcgatcgcccaggccacgccctatcccgcgctggaaatgcgccgcgcctggctgggcgcgctggagcgcctgatacaggaaaaccgcgagacgctgatcgccgcggtgaatcaggatttcggccagcgcagcgcggtggagacccgcctggcggagctgttcccctcgctggaggcgatccgccacgcccgccggcatctgaaaggctggatgaagccggagcggcgccgggtgtcgttctggttcatgccggcgagcgccagcgtgctgccgcagccgctgggcgtggtgggcgtggtggtgccgtggaactacccgctgttcctggccttcggcccgatcgtcgcggcgctggcggcgggcaaccgggtgatggtgaaaatgtccgaatacacgccggccaccggcgcgttgctgagcgagctggcgctgcgctatttcggccgcgacctgttgaccgtggtcaacggcggtccggaactgggccaggcgttcacccggctgccgttcgatcatctgttgttcaccggctccaccgcggtggggcggcacgtgatgcgcgccgcggccgacaatctgacgccggtcacgctggagctgggcggcaaatcgccggcgctggtggcgcggggggccgatctgcgccgcagcgccgaggccatcgtcgccggcaagctgatgaacgccggacaaacctgcgtggctcccgactatgtgctggtcaacgaaaaggactgcggcctgctgctggacgagatccgcgccgccgcggcgcgcgcctacccgacgctggccgacaaccccgactacagcgccatcatcaacgaccgccactaccagcgcctgcaaggctggctggaggcggcgcgccaggccggcgcccgcatcgacgcggtgaatccggccaacgaaaacctggccgcccgccgcaaattcccgctgacactggtgcagcgctgcccggacgactgcgcgctgatgcaggaggagattttcggccccattctgccgattgtcgcctacgacaagttcgacgaggcgctgagctacatcaacaagcggccgcggccgctggcgctgtatctgttcgacaacgatccgctgcgggtggagcgggtgctcaaggaaaccgtgtccggcggcgtcagcgtcaacgacaccttgctgcatgtggtgcaggacgatctgccgttcggcggcgtggggccgtcgggcatggggcattaccacgcgaaagaaggcttcctcgccttttccaagctcaagccggtgttccgccagagccggctgtccggcagccggctaacccgggcgccttacggccgcatggtcgaatggctgctcaagctgatgctgcgccgctgacatgcccagccgccgtgaactgctgaaaaccggcgcgctgggcgcggcggcgctgttgttggccggctactgggccacgccgcaggccgacccgctggcgcagccgggcggcgcggccacgctatggctgcagccgcaggacgcggccatcatccgcgcgctggcgccggtgatgctgggcctggatggcctgccgctggagcaggtggcggctggggtggacagggcggtgctgggtttgccgccggcgctgcgccaggagctgcggcagctgttcgatctgctgcagaatcgctgggcgcgccgctggctggccggcatcggctcgccttgggcttcggccgcgccgcacgaactggaacgctttctgcggcgctggcgcaatagccgcttccagctgaagcgcagcgtctatcaggcgctgcaccaattgatcaacgccgcctggtacggcaaccccgccagttgggccgcgctgggctatcgcctgccggaaggcgtggtggggatgctgccttgagcggcaagatccccgatccgatccgcgccggactggccttgggctggaaagcgttcgatggcgccgcgcagggccaggatctggcttgggatgccgatgtggcgatcatcggcagcggcgcgggcggcgcggtggcggccgaggcgctgagcgcagccggtttggacgtgctgattctggaggagggcggtttttacagttccagcgatttccgcatgctggaggccaaggcctatccggagttgtatcaggagtcggcaggccgccagacggcggacaaggccatcagcattctgcaggggcgttcggtgggcggcggcaccacggtcaactggaccagcagcttccgcacgccgccggataccttgcgctggtggcaggagcgctatggcctggcgtcgctgaccccggaagccatgcggccctggtttgaaaaggcggaggccaggctgggcatcgcgccctgggacgggcagcccaacggcaacaatctggtgctggagcgcggctgccaggcgctgggcctgcgccacgccaggatacggcgcaatgtgcgcggctgctggaacctgggctattgcggcatggggtgcccgaccaatgccaagcagtctatgttggtcacctgcattccccaggcgctggagcacggcgcgcggctgttgtcgcgggcccgcgtcgatcgcttgcaggcgaatcaatccagcagccggatcgtccaggtccatggcagcttgctggcggcggacggggtcctggcgaccgggcggcgcttcgtggtgcgcgcccgccatgtggtgctggcggcgggggcgataggctctcccgccattctgttgcgcagcggtttggcggattcgtcgggccagaccggcaagcgcacctttctgcatccggtcgctttgtgcgcggcccagatgccggaattgatccagccgttcaacggcgcgccgcaaaccgtttattccgaccacttcatgcatacccaatcgctggacgggccgctgggcttcaagctggaggtgccgcccatccaccccttgctggccagcgtcacctttcccggctggggagcccggcaggcgcaactactgcggcagttgccgcatctgcacgccacgctggcgctgttgcgcgacggtttccatccggacagccagggcggcgaggtgcgtctgcgcggcgacggctcgccgctgctggattatccgttgaacgatgtgatctgggatggggtgtaccgcagctggctggcgatggccgagctgcaattcgccgccggcgccagcctggtgatgccgctgcacgagcgggccgagccagtcagctcatggcggcaggcgcgggagcagatagcggaattgccattgcaggccttgcaggccaagttggtcagcgcgcacgtaatgggcgggatggcgatgagcgatgatcccagccgcggcgtggtggacgaatacggccggcactggctgtggcgcaacctgaccatcatcgacggctcgatttttcccaccagcataggggccaatccgcagctgtccatctatgccttcgcctggcgcgccgccgacgctctgatccggcaattggggcgggagggctgagctcagcgcggctcggtttgttggcgcagctgttcgatggccacgctcgccgcgctggccgccacggcgtaggcgccgtcatccagcgcctgttccgcctggctgaactgctggcggttgaccaggccggcgatcttggcggcttccagatggaggatggcgtggcggctaaggcaagtctggtacacgctcaggtggccgaagcggctttgcccggggccgtgcagccacttgcccaattcgcagcagtcgtcgcggccgatgttgtcctcatccatccgctcttgcatgaaaatcgccaccctgaaccgggtttcccattccacgtgtttgagcaaggcctgttgcagatccatctcttttcaaccgggtttcatttgcgccaagcgcgccgtctgcctggcggcggccgggaagttcgaattcgacaagccattattggtgaatggtgttgtcagatatttttatagatagactaagtaaattcacttatcaagaatgagcgagcgcggcctcgtcgccgaggccgcgccgtgatgggcggcagggatcagccgcgcgattcgtcaagcggaggagcggtttccgtttccgcctgcggcgcagacggcggcggcaggaagaaggccagcggctgccgcaggaagcgcttggccagcatgggcaccagcggcagcagcatggtgccggacagcttgcgcgagcgcagcgccacccacagcgccatgaagaagctgaccgcaaggttggtcatgccgatcagggcgacgccggcgcagcccagcagcaccgcggacaacggcacctggaagtccagcgccacgctggcgaaggccaggttggccgacgagaaggtgatgtggcggatgtccagcggcaggccgaggatggtgcctatcgtgccggacaggaacaggaatatcccggcgatggcggcatgcggcagggccaggctgtgtagcgggtcgatctcgtgcaacagcttttgcgccttggcggcatccaccaccggcgcgccgaacagcgcgctccagcccagcgcgatcagcgccgcggtgggaatggccagcagcacattgcccatgatggcgacgaattgggtgcgcaccaccttggtgatcaggtcggccagcacttccagctgcttcttgcggccgttctgctcgtgcagcgccgccgccaggcgggctgcggtcatcgcgggctgcttggtggcgatggtcaggtgcaggatctgcacgatgatgaagccgatcgcgtaattcaggccgaaggcgatgccttcccacagcagcggcaggtggccgcgcgcaagcatcagcttgatcagcgccatgaagccgacgatgaagccggcgcccatcgccgccttgcccatcttggcccagtcgcggcggtcctcggcgatgtagtgctcgccatggcggccggcatgctcggtgacttgcagcgccaagagctcggtgttggacttgaacaggtcgcgcaggctgtacttgcggttttcggcgcgggcgaagtccaccagcaatcggaatagctggggcttttccgccgggtcgtgctcgggcgacaacagctccagcagcgcgcgcagccgggctatgctttgcgccagccgcaggccgtggtaagtgaggctgacggaaatgccgtaacgggcggcgtttttgcgcactttgccgaggatggcttcgcactgctccagcagcaccagcacctgtttttcgtcttccggcggcggcgtgccgtccaccagcgcctggtggtagccatccacgtaacgctgcacttcggcgttcaggtgcatgaagggcgaggcgaagcgctctacttcggggcagacccgcaccagctctggctccaggccgatggcggtgatgcgggccgacagcacttgcacggactccagcaattgcagtcgggtctggcgctcgctgtcctggcgcggcgcttcgtcccaggccagagcgcgccacagcgcgtgccaggtggcgtcgggcaccgcctccagccacagataatcgtgcttgtggctgaacagcaggccgaagcggtcgcgcagcgagtcgggattgtggggcatgggcagcgcgcgctcgcccagacggtgcagcaacgtagtgccgaagccgtcgttggccaggatgccggcttcggtgtagagcggaatctggcgggtttccgccagcagcgtgcacagggccaggcgcagcgcctggcggtagtcggcgtgatgttccagcagaaaagacaacgcttgcagattgacggtggactgctgcggcgcctgtccgttgccggggcgcaaggcggccaccagcaaggcgagggtttcggttttgccgggctcctggcaaagccggcgcagcgaggattccaggtcgggagcggtgtgttctgtcatgttttaccaggttgggcgcgcgctggcgcgcggacttgaggggatgcttgtcattttagggcatttgtccggcctgcggcagggggcggggccggccggaggccgccgcgggcgattgacaccttactaaccagtaagtagagtgatttgatgagcaatggttccgacagcaaaaacgacacccgcaagcgcatcctcgacctggccgaggagttgctgctgacccgcggcttcaatggtttcagctaccagcacatcagcagcgcgctgggggtgcgcaacgcggccatccattaccattttcccaagaagagcgacttgggcgtggcgctgatccagcgctatcgccgccgcttcctgcgcttcaccgaacagcaggcggactgggacgcgccgcgcaggctggaaagctatttcggcttgtcggaccagtattaccagcagcacaagcagatctgccccagcggcatactcagcaccgaattccagaccttgccggaagatatgcagcaggaggcgtccgctttcatcgacgagatgcggcagtgggcggtcgccatcgtcaggctgggacgggatgtcggcctgatgcgctatgccggcacgccggaagcggtgggcatgatgctgttttccgccttgcaaggcggtttgcagctggcgcgcatcgacgacggcgccttgccgctgctcaagcagcaggtcagggtgacgctgggcctgggcgaatcatgacaacacgaagaacagaactacagaggggttaaacatggaataccgcaagaacagcatgagccggatcgccgacaaggtgggccgcctgccggtgggctggcgccgcccggtgttgtcgatgatgttcggcaagatcgtgcccttcctctccaccgccggcttgcgtttcgaggatgtcgggcacgacaagctgaccgtctccatccgcaaccgcaagaaggtgcaaaaccacatccgcggcgtgcatgcggcggcgatggccttgctggcggaaacctccaccggtttcgtggtcggcatgaacatgccggacgacaagctgatgctgctcaagtcgatgaaggtgaattacgtcaagcgttcgcagggcgatatgcgcgcggtggccagcctgacgccacagcagatccagcagatgtacgagcaggacaagggcgaggtgctggtggaggtgttggtcaccgacgactccggcgaatcgccgatcgtctgtgaaatgttgtgggcctggattcccaagaagcgtccggaggcgagcgcggcatgatcgacttgcaaaccctgaccgtcgaactgaacgacaaggtcgcgctgctgcgcttcaatcgcgcggacaaggccaacgcgctcaatcagcaaatgtggcaagacctgcgcagcgcgctggactgggccgatgccgagagcggcgtgcgcgcggtggtgctggccgggcacggcaagcatttctgttccggcatcgacctgtcgatgctgatgggcctgcaagcgctgattcaggatgagtgcgaaggccgcaaacgcgacaagctgcgccgggtgatcttggatctgcaggactgcgtgaccagcctggagcgctgccgcaagccggtgatcgcggccattcaaggcgcctgtctgggcggcgggctggatatcgtgctggcggcggacttccgtttcgcggccgagagcgcgatgttcggcgtgcgcgaggtggacatcggcatggtggcggacgtcgggtcgctgcagcgcctgcctcgggtggtgggcgagggcgtggcgcgcgagctggcgctgaccggccgcgacatggcggcgcgggaagcgctggatgtcggcctggtcaaccgcgtgctggcggacgccgacgccgtgctggcggcggcgctgcaaagtgccaggctgatcgccggcaagtcgccgctggcggtgcgcggcagcaaggaagtgctgaattacagccgcgaccacagcgtcgccgacggcttgcagttcgtcgcgggctggaatgcggcgatgctgatttcggaagacatccagaaggccggcatggcggcgatgctgaagcaggaagccagcttccgcgattgagcggcgccgcgttggcggccggcgtatgggcatgaaaaaagaggcgccgctggcgcctcttgctcattgcgggagggggcttagttgccgcccacggtcgacaccacttcccacttgccgttcttcacctggtagacagtgacggcgccgttcttgatgtcgcccttgtcgtcgaaggcgatcttgccggtcacgccgctgtagtcggttttgccgacttcaggcaggtaggctttggggtcggaggatttggcgcgcttcatcgcatccaccagcaccatcaccgcgtcgtattcgaacggcgcgtagatctgcacgtcggtgttgaattccttcttgaacttctcgtcgaaggccttgaagcccggcatcttgtcgcgcgacacgccgcagctggacgcgtactggccgtcggaggcgtcgccggcgagcttgatgaattccggggtctgccagccgtcgccgcccatcagcttggccttgatgcccaggcgctgcatctgcttggccagcgggccggcttgcgcgtccatgccgccgtagaacaccaggtcgggtttggccgacttgatcgaggtgaggatggcgttgaaatcggtggcggtgttgttggtgaattcgcgtttcaccacttcggcgcccttggccttgaccgcgccttcgaactggtcggccaagccctggccgtaggcggtgcggtcatcgatgatggcgatcttcttggctttcagctcgccggcggcgaattcgcccagcgccttgccctgctgcacgtcgttggcgatcacgcggaaggtggtcttgaagccttgcttggtgtagtccgggttggtggcggacggcgagatctgcgggatgccggcgtcggagtagatcttggaggccgggatggtggtgccggagttaaggtggccgaccacgccggccacgccggcgtcaaccaggcgctgggcgacctgggtgccgattttcgggtcgccctgatcgtcttccgacaccagttcgaacttgaccttcttgccgccgatttccacgccctgggcgttgaggtcctcgatggccagcttggcgccgtattcgttgtccttgcccaggtgggagatcggacccgacatcggcgaaacctggccgatcttgaccacagcggcgtcgccgccggcggcttgcgccggagcggaggaggcctgtcccgaggccggctgctcctgcttgctgcaggcaaccatggcgatggctgcggtagcgatcaggctgaggcgagcgtatttgttcattgagcgttcccctgaatcttatctgcgtagactttagatgatctctttggtaaaccaacaacaccattaagaggctgttagttgcaactgattatggtgaccagtttgcaagggtgtcaatctggaaagacgctgacccaatgactataggaccattatttacattttgcggcaaacaagtaaaaaacgggcgcgcggcttgaatgcccgcgcgcccggatggtcttttatcttgttgattttgaagaaatagcgggtagtgatgccgcctgtggccttaaggcctgatgtcagctggatgcccctttttcacgcgctcgcgcttggcgggcgcggccatcttctgccggattttccagccagccggcaagattgtcttttacaattgtcgcaagtgagactatccattgcgagtcttcattcaggcagggaatgtagcgaaattcgccaccgccgctgctcaggaaggtttgcttgccttccatcgcgatttcttccagggtttccaggcagtcgccgacaaagccgggacagatgacatccaccttggcggttttcgccttgcccagctgttccagcacctcgctggtatagggtttcagccattcggtgcggccgaagcggctctggaaactgatgacatattgatcgggcgcgagacgcagggcctcggccaacagccggccggtcttctggcattcgcagtgataagggtcgcccttgtcgcgggtgaagcgcggcacgccgtggaagctcattaccagcttgtccggctgctggccatattgccagtgcttgcgcacctgtgcagccaacgcggctatatagcccggattatcgtggaaatggcgcacggtgcgcacttccggcatattgcgcagccgcgtcagcacgcggaacgcctcatccagcgcggtggcgctggatgaggccgcgtactgcggatacagcggcagcagcagcagcttttccacaccttgttcgcgcatcttgcctatcacgctttcgatggacggattgccgtagcgcatcgcgtaatcgaccaccagtcccgtcatccccatttcgcccagctggcctttcagcaacttggcctggctgcgagtgtgcgtcagcagcggcgagccatccttggtccagatgctggcgtatttgcgggccgattgcttgggccgggtgttcaggatgacgccgttgaggatcagccaccacggcagacgcggaatctcgatcacgcgcggatcggacaaaaactgcttcagataggggcgcagcgcctgggcggtgggggcgtccggcgtgcccaggttgatcagcagcacgccggtcttgggcgcgtagtcgtggcggaaagccggttcaggcagatagcggggcatggccatccttttattgtggggaagggacgccggcatggcggcgtccgcggtctcagtcttctcgggccggggccagcacggtccggttgccgttgctttccatcgccgacaccaggccggcggcctccatttgctcgatcagccgcgcggcgcggttgtagcctatgcgcagatggcgctgcaccgaggagatcgacgccttgcgggttttcaccacgatggcgacggcttcgtcgtacagcggatcggcctcggcgtcggactcgccatccaggccgctggagctggcgccatcgtcgccgtcggcctggccggtgaggatgccttcgatgtaatccggttcgccggtggtcttcaggaattccaccacgtgatggacttcatcgtcggagacgaaggcgccgtgcacgcggttggggtagccggtgccgggaggcaggaacagcatgtcgccctggcctagcagcgcttccgcgcccatttggtccaggatggtgcggctgtcgatcttgctggacacctggaaggcgatccgcgtcgggatattcgccttgatcaggccggtgatcacatccaccgacggccgttgggtagccagaatcagatgaatgccggcggcgcgcgccttttgcgctaggcgggcgatcagctcttcgatcttcttgccggccaccatcatcaagtcggccaattcgtctatcaccaccaccaccagaggcagggtgtcgaggggctccggcgtttccggcgtcaaactgaacggattgggaatcttctcgccgctcttgtccgcatctttgatcttctggttgaagccggccagattgcgcacgcccaatttggacatcagcttgtagcgccgctccatttctccgacgcaccagttcagcgcgttggccgcttgcttcatgtcggtgaccaccggcgccagcaagtgcggaatgccttcgtataccgacagttccagcattttcgggtccaccatgatcaggcggacttccttgggcgtggccttgtacagcagcgacaggatcatcgcgttgatcgccaccgatttgccggagccggtggtgccggccaccagcacgtgcggcatcttggccaggtcggccgaaactggctggccggcgatgtccttgccaaaggcgatggtgagcttggacgccatgttctgatagctgtcggagccgatgatctcggtcagccgcacgatctggcgcttggggttgggcagctccaggcccatataggttttgccgggtatggtttccaccacgcggatggaaaccagcgacagcgcgcgcgccaggtccttcatcaggttgacgatttgcgcgcccttgacgccgaccgcgggctctatctcgtagcgggtgatcaccggacccgggtaggcggcgatcactttgacgtcgacgccgaagtcggccagcttgcgctcgatcaggcgcgaggtgtattccacggtgtcctgtgataccggctcctgctgctccttggcagcatccagcagagtcaggccgggcagggcggcgtccttggggtcggcgaacagagattgctgcaccggcttttgggccttggccgacactggcacctccagcaccggcggctcgatgcgcaccggcgtggtttcctcgattttcttcttggcgacggaaaccttctcttcgcgcttctgcgcggtttccttgccgatttcgcggtcctttttcgcctgccagccattccatagccggatggcaccgtcttccagcgccgcgccgatgcgctccatcaggtccagccaggagaggccagtgaacagggaaaatcctatagcagacaatacgcccagcagcagataggcgccggacagccccaggccgtgggcgatgcccttgccgatgaagtggccgagcatgccgccggcctccagcggcagcgtcaccgccttgccttccagcacgatggcctcgaagctggcgctggatagcagcagcaggaagaagccgccgaccgcggccatcgtgattgggctgaacttgaaacccagcgattccatgcggcggtagccccagcctatcgccaccaggcagaacaccaccagccaccaggcggaaaggccgaagatgtatagcagcatgtccgacagccaggcgccgaaagcgccgccgtagttgcgcacggtggggtcggaagagctatgcgaccatgaagggtcttgcggagagtagctggccaataccagcacaagatacaccgcggccaccgccatcagcagccaccatgcctcgcgcagcagggcggccagctgcggcggcagcggcgtctggttattcttgactacggctttgcgcttgaaaaatcgcatttacgattgcaacctgttgaattttatagaaatctttgtttttgtggcattcgggcgtgcatggctaactgatgatttttgtgaggattatgcacatgataatactgtcttctgaatggtcataagtctaccacggcggcggaattgtgttgatgaatagcgattgctatcaacttgcatcatgctgcgccaaagagttgggcagatgaagtggcgggatattgttcggcaaaaaaggtgatatgacggagtgttgcgcggtgtcggccctttgattgatagcctgcatgccatcgaatggaaaaaccggttatgtagctagtataaggcatgcaaacaccccgcgtgagcggggtgtttcggtgcgagccagcttagctcggaaggatccggtattgcaagcgatcaatcagcccgccgctgctgatgccggtaaacgtaatttgacacccgtccatcgcctccagcgtagccgagttggcgttgaagttgccgactttctttatcgatccggaaagatcaaattccagatagctgacaaccatatagccttgattggttctggcctgcatcttttttagaataacaacgccatcattgggcatggttaccgtcaaggattgcaggcctttggtgttgccgccataggaagtgctgccgacagtaatattcactagcgcgtcaccccaatagaaggtgacctggctgcctgacatgttgacaccttggagagcgccgccggcgccgccaaacgtttgcttgatttcggccatgatactttccttttaaggtgctgatttaatatcggtgaaattcaatggctattgccaaaataaatataggagaaggcgtgtgcggcagacctgtcctttgggttggtatttggccatcagtccttggttggtgatgccggcgtcgagccaatgagcaaggagcttgtctaggcgctgaagggggatgtttctgtcgggcgccgatgtcgatcgctcttttgtattggagagtctgctggatggaatgaattaaccctattaggtttagtggtatggattcattgtctgattgaactcggaggggcgcctgttgccaaacattgggtgtggatggctacaaagagaggcggctggaggcgagttttcccatggtgtgtgatgcgatgagcctggttgaagccttggcgcaactcgatacgttcttgtatgaatggaaaagggagaggcttgttcgtcaactttggtttgaataatcgctgtttcttgttcggtgtattgtttggcgggcttgtttaagacgaccctgccggtcattgaaaaacagcgtcaacgtgagagtgcgctacctatctggtgataggtttgtgcgcgcgctgaccgcaggaatgccggccgggcaatctctggccatggtttggcgatggcgtccgcggattttggccggcttgcgtggggaaaatcctgcttgggaatcgttatggtgcgatcatgtgccatgatcctggtggatcatggcctgatcttatcggggatgcagcgcgcccagcacgcgaggcccctgcgcgccggtgacggcaggcaggtttccggcttggcgctggttgaagcgccagcccagccaggcgaaggcgatggcttctatcagctgggccggcagcccgagcgcctccaccggctcgatgttctggccggctagcaggcgcgccagctcggccagcagcgcgccgttgcgcgcaccgccgccgcagacgtagaccgcctggttgtccgggcaatgccgcaggatggcgtcggcgatgcagctggcgctgaaggccagcagggtggcctgcacgtcggccggagccagcgtttgcggctgacgcgccagttgccgggccagccagtcgtcgtcgaacaggtcgcggccggtgctcttgggcggagcctcgcgcagataaggttcggccagcatgctttgcagcagcggcggatctacccggccgctggccgcccagcggccgtcgtcgtcgtagggctggccggtgtggcgcaggcaccaggcgtccatcagcatattgccggggccgcagtcgaagcctatggcttcccggcccggatgcaggcgcgccagattgctgatgccgccgatgttgaggatcacccgacgttcgcgctcgctggagaacacgcattgctggaaggcgggcaccagcggcgcgccatggccgccggcggccacgtcgcggctgcggaagtcggcgatcacgtcgatgccggagagctccgccagccgcgacatattgcccagctgtatggtgtagccagcgtgcggggcgtggcgtatggtctggccgtggcaggctatcgcgcggatgtcggcgggcgcgtggccgctgcgggagagcagctcggcggcggcgcgggcgtagatttccgccagccggttggccagccgcgcgctgcggtgcagttcgtcgtcgccgcgcggctgcagcgccagcacttctgccttcacttcgtccggatagggcagcgcgtgctccgccagcaactccgggcggccttcggcgtcgaaacgcgccagcacggcgtctacgccgtccaggctggtgccggacatcataccaatatatagctcgctcatcagtcgacctgcgctacgttgaccgggatattctgcagcaactgcagcctggcgctcaactgcgcgcgcttggcgccgaactgggccagctgggtcttgcccaggtccggcgcttgcagcgcgttggtggccgggtctaccggctggtcgttgatcctcacttcgaagtgcagatgcgggccggtggctcggccggtgctgcctacgtagccgagaatgtcgccagccttgactttgccgcccgcgcgcacgcccttgccgaaggcgctcatgtgcgcgtacagcgtggacagcttgctgttgtggcggatcatcaccatgttgccgtagccgttctcgcgctggactttcaccagctcgccgtcggccggcgccacgatgggcgtgccggcgctggcggcgtaatctatgccggagtgcatgcgcagcgcgtgcagcaccgggtgcatgcgcaggccgaagcccgagctgatgcgcgcgccggccaccggctggcggctgaagcctttcttcaccgggcggccggcggcgtcgtagtaggcgccgctttcgctgtcatgggcgaagtaaaacgcctgatgcagtttgccctggcgttcgatcgacaccgccagcagattgccgctggcgatggaagcgccggcgtacaccatggtttcgtacaccagattgatgcggtcgccgcgtttcaggctggagagttcgaactgatcggcgaaaacttcggacagctggttgcggatgtccgccggcacgcgagcggcggtcaattcggcggcggcgcttctcttcagtgtgatcgagcgcacggtttccacgctttcggccgccaccgggtcggcgctggcctgccatttgccgtcgcgcttctccagcgccaccagcacctgttcgccgttgtcgtcatcctgcaggaagcgcaagccgaacagctcgccggcgtcgttggtttgcaccgtcagcgtggcgcccaccttgagcttgagcaggtccttcgccagcggactggtgtacaggaaggcgttggcctccttgtcgcgcacgccgacgcggttgagcacgcgcgccacggtgtcgccgcgcttgatgctttcatcgcgccagtagcgggtctggctgtcggcgaattggaatttcggcagcgccaggcgttccaccacctgttgctgcaccacctccgggccgcgggtttccttggcgcccaccgccacggcgaaggcggtggcggtgcccagcatgggcaggcaggcggccacgccgagccagctgaggtggtggttgatcagcttggacgcgcatttttgcgggatgtgtagcagtttgcgataatccatcaattttccgggcgggccgcggctcgccatgcataaacattgatcagggtccggtcccgcgcatgtcggggaggccggcgccaaacagggttggttcggcgagtcgcgcgatagttccggcaaagcggccagtttgccgcagaatcgctctccggccaaatgccccatggtcaaaatggcgcggatccgcaatccatctggcaagaatatgaaattaatcctgttgttaccgggcctggcctggctggacgcccatgacggcggcgaagtgagcaaggcgctgccgctgcccgcgctgcagcaaatgctgggcaaggggcggcttgagcgcaaggaacgcggcttgtcggcgtgcgtcgaacagctgtggggcgcgccgcccgccggcctggccgcgctggcggccgagcaagccggcctcgccggggacggcgaatggctgttcgccgacccggttcacctgcgggtggaccgcgaccgggcattgctggccgatgtcggcgtgatgcagatcagcctggacgaagcgcgcggcctgaccgacgcgctcaaccgccacttcggcgaagacggcttggccttccacccgcagcaagcggggcgctggctgctgaatgcgcccaagccgctgacggcgcgcttcgatccgttgtgggatgtggtgggagaggacatcaatcgccacctgccgcaaggcgagggcggcctggcctggagccgcatgctcaacgaattgcagatgctgctatacacgcagccgctcaacgacgcgcgcgaaatgcgcggcgatttgccggtcaacagcgtatggctgtggggcgagggcgcgcccgcgccctggaaggcgccggcgccggcgctgcttgccgacgacgaatcgctgcagctcttggctgcgcgcagcggcatggcggtggacgccgcgccgttcgctttcgacggcttgccgctggacggcgactgcctgctgatgctggacgcgctgcaggcggcggcgcaatatcgcgacgcctggggctggcgcgaggcgctgcaacggttggagcaggactggttcgcgccgctgcagggcgccgttcgccaaggcaagatcagcgaattgacgctgatcgccaccggccccgccggcttcgagctgacgctgaagcccgccgatttgtggaaattctggaaacgcgcgctgccattggcggcgctttactgagagcctatgtcgcagatcgtcacccgggaagttcccgttccgttgcagcaaaccctgctgcagcaaggcctcacgccgctgcaggcgcggctgtacgccgcgcgcggcatcgccgacagcgcggagctggattacggcctcaagggcctgctgccgttccagaacctgaaaaacgccgaagcgatggccatgcgcctggccgacgccatcgccgcccgccagcgcctgctggtggtggccgactacgacgccgacggcgccaccgcctgcgcggtggcggtgaaggggctgtccgcgctgggcgcgacgatagacttcatcgtgcccaaccgctttgagtacggttacggcctgacgccggaaatcgtcgaactggcggcgcggcagcgtcctgacatcatcatcacagtcgacaacggcatcgccagcgtggccggggtggatgcggcgcgcgcgcgcggcatcgaggtgctggtgaccgatcaccacctgccgggcgacacgctgccggacgcgctgatcgtcaaccccaatcagccgggctgcgaattcccgtccaagaacctggccggcgtcggcgtgatgttctacgtgctgatggcgctgcgggtggaaatgcgccggcgcggcgtattcgacgagcgcagccagcccaatctgggcgagttgctggacctggtggcgctgggcacggtggccgacgtggtgcggctggaccgcaataaccgcacgctggtggagaacggcctcaagcgcatgcgcgccgggcggatggcgccgggcatcgccgcgctgttcaaggtggccggccgagccagctacaaggccaatactttcgacctgggcttcaccctgggaccgcggctgaacgccgccggccgcctggacgacatgagcttgggcatcgcctgcctgttgtccggcaacgagcagcaggcgacggcgctggcgcaggagctggacaagctcaaccgcgaacggcgcagcatcgagcacggcatgcaggacgaggcgctggcggcgctgtccggcatcgacgccggcaaccgctacacgctcacgctgttccgcgacgattggcaccagggagtggtcggcatcgtcgcctcgcggctgaaggaacgcttccatcgcccgaccatcgtgttcgcgcccggcgacgaaggcgaaatcaagggctccggccgctccattccgggcttccacctgcgcgacgcgctggatctggtgtacaagcgccacccggggctgatcctgaagttcggcggccacgcgatggcggcggggctgacgctggacgaggggcgcttcggcgagttccagcaggctttcgaagcggcggcgcagcaactgctggatgaaaagcagctgacgcgcaccatagaaaccgacggcagcctgccagcgcgcgaattgagcctgcaactggccgagcagctggcggcggaggtctggggccagggcttcccggtgccgtacttccacgatcaattcctggtggtgaaccagaagctggtgggcgacaagcacttgaagctgcggctggcgcgcgaggggcaggaattcgacgccatgctgttcaaccatgccgactggctgccggaccgcatccaggcggtgtaccagctgatcgccaacgagtggcagggtcgcaaggaattgcaggtctacctgcaacactgggcagaggcgtgaagtagggtggatgtcttgagggcgatccgccatttctccaccatgcggggcggagcggccggttagccgggaaccccgccctgcgcgggcatcaagcgggatggaaagcgaaatggaaatgttgatcatcggcctgctggtcggtttgatgggcggcggcgcggcctggttcgccgctcgggcgcgcgccgcgcgcgagctggcagaactcaagcagcaagccgcgcagctggatgcgcagtgcgccggcttgcgggaacagctggacgaggcgcgccgccgcgagagcgccgcggcgcaaacagcgcaggaacagagccggcaactggccgacggccagacccagctaggcgcgtatgtggcccgagcccagcgggtgccggagctggaacgccagctggacgagcgcgaaaagcagctggaggcgctgcgcggcgaattgcgcgcggcgtcgtcgcaactggcggcgcgcgaggagcaggggcgggtgctggaggcgctggaagcgcgcagcctgcagcagggccaggacatcacccgcttgaccgcccgcgagcaggaattggccaccttgctggaaagcgagcggcggcaaaaccaggagaagctggcattgctgatggatgcccgccaagcgctgtccgaccaattcaaggcgctggccggcgacattctggaagaaaaatccaaacgcttcaccgaacagaatcagcaaaacctgggcgccttgctcaatccgctgaacgagcgcatccagaatttcggcaagctggtgcaggacacttacgacaaggacagcaaggagcgcctgtcgctggaggtcgaactcaagcggctgcaggagctgaacacccggctgggcgacgatgcgacggcgctgaccaatgcgctgaccggcgccagcagcaaggcgcagggcacctggggcgagatggtgctggaaaaggtgctggaaacctcgggcttgcataaggaccgcgaataccgggtgcaggtgtccgacgtggtgcaaaccgaagacggcgccaagcgctaccagccggacgtggtgatagacctgccggaaggcaagcagctggtggtggactccaaggtgtcgctgaacgcctatgtccgttacaccgcggcggaggacgacgcggcgcgcgaggccgaactcaaggcccacatcgccgccatccgcgcccatatccgcacgctgtcggaaaagcgctatcaggatctataccagctcaacacgctggacttcgtgttcatgttcattccggtggagccagcctatttgctggcggtgcagcacgacatgagcctgttcaacgaggccttcgagcgccgcatcatgatcgtcggccccagcacgctgctggcgacgctgcgcaccgtcgccagcatctggcgctatgaataccagaaccagaacgcgcaggagatcgcgcgccagggcggggcgatgtatgacaagttcgccggtttcgtcgccaatatggaaaagttgggcaaacagctggacagcagccgcgacaccttcggcgacgcgatgcgccagctttccagcgggcgcggcaacctgatgagcagcgccgagcggctgcgcaagctgggcatccgcaacaacaagcagttggcggcgcagttgcggctggacgacgccggcgacggcgaagaggacggcgaggcctagtcggaagcttggccaatggcatgcgaccccgcgtggcagcgcgcgagcggcgggcggcgaaaatacattaccatgacgcctctttcatttcgtatcgaatatcgcgatgagcaagatcagggtaggtttgattttcggcggccagtcgtccgagcatgaggtttccctgcagtcggccaggaatatcctggaggcgctggatcaggacagattcgaggctttgctgatcggcatagacaagcagggccaatggcatgtcagccagcccgccgactttctactgaatgccgatgatccggcccgcatcgcgctgcgccagtcgggcgaaggcctggcgctggtgcccggccagagcgaacgccagctggtggccgccgccgacgcccatccgctggcgcagatcgacgtggcttttcccatcgtccacggctctctgggcgaagatggctcgctgcagggtttgctgaaaatggccaacatccccttcgtcggcgcgggcgtgctgggctcggccgtgtgcatggacaaggacgtggccaagcgcctgttgcgcgatgccggcctgagtgtcgcgcccttcgtcacgttgacgcggggcaaggccgagcaggccgatttcgcggccatcagcgccaagctcgggctgccgctgttcgtcaaaccggccaatcagggttcgtcggtcggggtcggcaaggcgcgcaacgaggcggagttccgcgcggccctggccgaggcgctgcgttacgatcacaaggcgctggtggagcgggcggtggttggccgcgagatcgagtgcgcggtattgggcaatgaccatccacaggccagcggctgcggcgagatcgtgctgaacgacgagttttacgcttacgacaccaagtatctgaacgagggcggcgcgcgggtggcagtgccggccgacattccggatgaagcctgccagcgcatccgccgcatcgccattcaggctttccaggcgctggagtgccgcggcatggcgcgggtggatgtattcctgaccccggacggcgaggtggtgatcaacgagttgaacaccttgcccggcttcaccaatatcagcatgtatcccaagctgtggcaggcggcgggcctctcgtacgccgaactgatcacggccttgatcgagctggcgtcggagcagggcgcgatggacgcggcgctgtgccgcagcgccggcttgcctggctctgcttaagctttttcggcgtttttatctatatttgtttacacgaggggtggcgctgggtagaatctcgccgcttcaattggcgagttgtatgcgcggccctcgcggctgccgcttgcgatttcgtttcgttcctgtccggcgcggttctctggggtgcgccgggcacggtccgcttcctctgaagcgccagttcggcgtggccggcctggcaaaccatctcaaaactactactagaaaagctgatgaaaatgacgtttgcgatcaagaccgcaggctgcgccgtagccgccgccctgcttgccggcccggtgctggccaaggacttcaatgtggccgtggtgtacgaccaggccggcaagttcgacaagagcttcaacgaagcggcctataccggcgccgaacgcttcaagaaagagttcaagatcaattaccgcgaaggtcagcccagcaacgatgcgcagaaggaacaagtgctgcgcaatatggcgcgcaagggcgccgatctggtagtggcggtaggcttcgcctactcccaggccatcgaaaccgtggccaaggagttccccaacaccaagttcacgctggtggattcggtagccaagggcgccaacgtgcagagcatcgccttcaaggagcaggaaggctccttcctggtgggcatggccgccgcgctgaagtccaaaaccggcaaggtaggctacctgggcggcatggacgtgccgctgatccgcgcctttggctgcggttacgcgcaaggcgcgcgttacgtgaacccgaaggctgtggtgctgcagaacatgctgggcaccacccacaccgccttcaatgacccgtcgcgcggcaacgagctggccaagagccagtacgaccgcggcgcggacgtgatcttcgccgccgcggcgctgtccaatgtcggcgtgatccaggcggccaaggcctccggcaagttctacatcggcgtggacagcaaccagaactacatgcagccgggcacggtgctgacctcgatggtcaagcgcgtggacaacgccgtgtatgaaaccatgcgcgacgccaaggacggccaatggaagcccagcgtcaagttgatgggcctgaaggaaaacggcgtggattgggcgctggacaagtacaaccgcgcgctgatcacgccggaaatggagaagaagatcgtcgccgcgcgcaaggacatcatcgccggcaagatcaaagtggtggactaccgcgccggcaacagctgcccggtgaactaagcggccaagccgccgccgaagccgggcctgacaggccgcgcggttccggtgtctcgatcatgacagcgcccttgggcgctgtttttatttccgcgccggccattcccgcctgcctgccggccattctcatgtcccttcttttacgacgcaccgcttgccttgcgtttgccagagctgtcgctggctgattaatatctggacggcattttaaaatattgcgcaatatgagtcaggtatgatttcgcgttgggccggataatccatccgagatgcccgcgccgccgtttcgccatcaggctgaagccttggcgggcggccgggccattcaatcactcacgccgcagggccagacagcaagggaccaagatgaaagaccttaccgaaggcgcaatcacccgccacatcctgacgatggcggcgccgattgcgatcggcatgattttccaggcgctttattttctgatcgatctgtatttcatcggcgaactgggcgccaatgcgcttgccggcgtcggcgccgccggcaacgcggctttcctggtgctggcattgacgcaggtgctgggcgtgggcacggtggcgctgatttcgcaggcggtgggccgcaaggaccgcgccgaggcgaacctggttttcaaccagtcgctgatgctggcgctgctggtcggcctgacggtgctgttgcttggttatgccgccgcgcatgcctatatggcgtcggtgtcttccgatccggcaaccatcgccgcgggccgcacgtacctgcattggtatatgccgggactggcgctgcagttcgccctggtttccatgggttcggccttgcgcggcaccggcatcgtccagcctacgctggtggtccagctgttgagcgtcatcatcaacgccatcctggcgccggtgctgatcgccggctggctgaccggccatccgctgggcgtggccggcgccggcttggccagcacgctgtcgctggtggcggcggtggcggccttgtggttctattttcatcggcttgagcattatgtcagcgtggatcggcgcttgctggcgccgcgctggcgcgaatgggggcgtatcctggccataggcttgccggctggcggcgagtacgcgttgatgttcctgttttcggcggtcatctattgggcgatccgcgatttcggcgcggcggcgcaggcggctttcggcgccggctcgcgcctggtgcagggactgattctgccggcgatggcggtggccttcgccgccggccccatcatcggacagaatttcggcgccggccgcgccgaccgggtgcgcagctgctttggctcggcgctgttgctgatcagcgcattgatggcggcgctggccgggtgggtctactggcaggcggaaagcctgatcggctatttcgccaaggatggcgaggtagtgcgttacggcgtgcagttcttgcaactgatcagctggaacttcatcgcgcagggcgtgattttcacttgctccagcgtgttccaggggctgggcgatacccgtccggcgctgttgagctccaccgtgcgcctgcttgccttcgtcgcgccggtgatgtggctgacggcccagggcggctttgccatcgagcaggtatggtacttttcgattggcagcaccttcatccaggcgctggtcagcctgctgctgttgcggcagcagtttagccagcgtttgcgccctgcggccgcattcgcgcgctgaggccaaggcggcgcggcggaatgatcacggtatatttcgccgcggcgccgccgcccgcctgcgcaagcggcggctttatggtattcttgcgcccctcgtcaaaacgccgtgacccgtcacccatccatgaaagacccttgcgatcattacaccttcgatctgatcggcggcgtacagaaaaagccaggccgcaagccgctgggtgagcgcgcgatgacggtggccgagcgcaagcggcgcagccgcgagatgcggcgcaaccggctgcaggagttgtcggtgacggtggagttgagccgagacgcgcagaagtcgctggacaagatgatcgagtggtggggcgtcagcaagaaggaagccatcaaccgcgcgctgttgatcgcctgtcaatcccagaccggccgcaccggcaccctgttcgatttcgagctgccgccgcagggcaagaagccgtcccgccgcaagccgcaaggttgagtctgagagaaagagccaataaaaaaacgccgcgatccgcggcgttttttattggcttcagcaaccgtagcgcttcatcgcctcgatggcgaggccgctgccgatgctgccgaacagattgccctcgacatgatgcgccttgggcagcagcgcgcggatgctggcgcgcaaggccggcacgccgctggagccgccggtgaagaacacggtgtcgatcgcctcggccggcagttgcgcgtcggccagaagcttgctaacggtggtggctaccctgtccagcatctgcgcgatgccggcttcgaaatcctcgcggctgagctcgcagctcaggcccgtctcgatcgggtccagcgccatgcggtgctgggcctggtcggacagcgcgatcttggccgcttcgacttccatcgccagccaatggccggcgcgttcctggatcaggcggaacaggcggtccagcttgttcggctcggccgcgtcgcggtgcacgtcctgcaggtccatccaagccttgcgggtgtaggcgaagttgatggtgtgccaggtggccagattgaaatactggctggacggcatttcggcgttgttgcgcaaccgggtcttgaagccgaacagcggcatcacgccatgcaggctgagctggcggtcgaaatcggtgccgccgatgtgcacgccgccggtggccaggatgtcgtcgcggcgttccgcctgggcgcggcgatccggcgacaggcggatcagcgtgaagtcggaggtgccgccgccgatgtcgacaatcagtaccagctcttccttctgcaccgaggcctcgtagtcgaaggccgcggcgatgggttccagctggaaggaaatttccttgaagcccacctggcgggcgatgtcggccagcgtgtcctcggctagcttatcggcttgcggattgtcgtcgacgaaatagaccgggcggcccagcaccacctcgtcgaaagcgcggccggcgttggcttcggcgcgcagcttcagttccttgatgaacagcgtgagcaggtggcggaagggcagggctttgccctggacttcggtctggctgtctatcaggctggagcccagcaggcttttcagcgagcgcatcagccggccttcgtagccgtcgatgtattcgcgcagcgcttcgcggccaaagcgggagtggtcttcctcgtaattgaagaacaccaccgacggcaaggtgatcttgccgtcttccagttgcagcaaggtgtcctggcccgggcgcagccagcctacggtggagttggaggtgccaaagtcgataccgcaggcgcgggcagcggtttggggcgtcattcaggcatctccttgaaataaaaaagaggcgcgatggtacgctcaaagccgcggcatgggaagggggaggctttcagtcttctggcttgaggcggtgcagccggctggcctggtgccgggcgtcttcttcgctgtgaaggtagcggcgagtggtttggatgctggcatggcgaaggttctggctgaccagcagcaagggaacgccggcttccagctggtggctggcggcggtgtgccgcagccagtgggtgctggcgcgcgccaactgggcgcgggtttcgtcgttcggcgcgtgttgcagggcgcgggcgaacacttctttgcagatcaggtaaatcgctttgtccgacaacggccccgcgcggttcttcgcgccgatgcggcagaccaggggggtatcgtcgccaatgccgatgtcggcgggcaggcccaatgtctggcggtaatggccataggcggccatcaactcatccgacagcgggatgcgggcgcgcacgccgcccttgcctaccacgttccaccaccagttgccgtggcggcgcgcgaggtcgcccgcgacggcgccggccacttcgctgcggcgggctccggtcaggtacagcagggtgaacagccactgcgcccgctcggcgtggcgaactgcctttgccgtgtcgcgcggcagcctatccagcgtggcctggatgtgccgccagcattcgccatcgagaaaacgctccacttccgcggtctggcgcggcgcgcggcggcgcagcagcttgaaagggttgccgttcagatagccggcgtcgttcagatagctgaacatcgcgccgagcacagtcaggctatgcgcggcgctgtgcggcgtcagccccttgctgaacggcttccagtgcggatggctgcgcgggcggggcgggcctatccattgttcggccgggtgcggcgcggcgaggaagcgttgatagtccagcacgtcttcgcgccgcacctgggccagtttttggccgcggctggccagccacagcagcaggcgttccgattccttgcggtaactggccagggtggcggcgctgctagtgtgctcggccaaccaagccagcaccgcttgggtgtcggattgcgcctggatcagcagcggcgaggcgttgcgggaggtctgcgggggggtgtcgggcagcatgacagtctggcttggtgagttgggccggattgtaagggatgccgccgcttcggggaaaccgtttccaatggcgtgcgggaggatggcggccgagggccggctggcgggagcgcgccggccctcggcagttaggcgccgatgcctagcaggcgctgcagccggtcgacgatttgccgcctgttcgcttcttcctgtcgataggcgctttcggccgctgccagatcggcggcgcaatgcggacaggtcttttcttccgggtggatgtattgcttgcaactgcggcagatggacagcgtagccggcggctggccgatttcgggcgcgcgcttgccctggtttttccatgtcagctctatcacctgtccgttgcggctgatctggctgaccactttcccggtggcgatctcctcggtgatcaggtcgaagcggccgaccgcgaacgaggcctgggcggcgtcctgcaacttgacgatgcgctcccgcaggcctttcttctgcaggtccagcacgcgatagtggcagtaagggttattgcccggcttgcccagcagcgagtgggaagtccaagtacagccgccgcggcagacgtcgttgtagtagcagccgcggcagtagccccacaggtcgtcgaccgagcgcagccggccaaagtgcatgccctcgctatgctgccagatgtcagccagcgtcatgtcgcggacattgccgccggagaagcctaccgtggccagcgacgggcagcctttgacggtgccgtcggcctccagcgccatcacggtctggccggcggcgcagccggtccagtgcacgcgctcgtcgccgaagccgcgccacaggtgctcgtaagggccgtaatagccgatattgttgcctacgttcatcaggaggccgcgttccagcccagacttgtacaggcgggcgagcagcggcatcagctcctgcaattgatagggctgcagcagcagctggtcgttgtccaccgcattgcccatcgccacggtcagctggatctgccagtgggtggcgccgatgtcgatgatcgtttccatcagctcgggcaggtccggcatggtggccgcgccgatctgagtgttgacgctgacggcgaggccggcagccttggcgcggcgcagcgcgtccacggccttgtcgaacgagcccggcacattgcgcaccttgtcatgcagcggcgccagcccgtccagcgaaacgccgattccgttcagccccgcgtccagcgcctgctgcaaccgggccggattgaggttgcgcccgccagtctggaccgcgcagtacatgccgtggccgcggatggcgcgtatcagctgcgcccagtccttgcgcagataggcttcgccgccgatcagcgtgatttcgcgggtgcccagcgcggccagcgagtctatgacctgcaggcattcttcggtgttcagctcatcagggcggcggtggcctgcgcgcgagccgcagtgtaggcatttcaggtcgcaggccagcgtgatttcccacaccacgtgcaccggcgtgtagcgcttgaaatcgtcgtcgctgagatagcgggcagggcggatggcggcgctctcttgcatcagtgtgtccttggcagggcgccggcccgatggcctgggccggcgcgagggaggcttactgctgtttttccagacggatgatttcgtctttgagctgggtcagcgcgttttgaatattgtcgtgctgtttcagctgttcctcagcctggctggccaaggccttgagctgggcgacatcggtgctgccgcgggactgctgcagcgcggcggcgtacagcggcatcaccggatggtggcgggcatggttgccggcgtgcggctgcttgcccggcgccagcttgtcttcggtcaccacggcgtggacaacgctgtgccatgcgccctgatagaagaaacggtagctggcgtagccttttgtccagtcttgctccaggatgccttgcagattgaaggtctcggcgatcatgctgttgggcgagctgggactgccttccagcgacagcacgatgtggtgctcggtggccttgtcgagcttggcctgggtgtagtggccccagacattggcgtggaattgcaccggcggattggtgctctggaagatctgggcggcgccggcaacctttttgctgacggtgtccaccaccaggtcgagggtcaggacgggggcgccgaggttgggcgaggcgacggtgaggcgggtatgaaacagccctgctgctgacatggagtgctccttggtcattggaggaatcgtgtagggacgaggccgcgcctctttagccgcccagcttggagatttccgccttcagttcggccagcgccgcttccagctgcggcctgctgtccagctgctgctgggccaggttggccagggttttcatatgggtcaggtcgccgctggcgatggcgctttggatagggacgccgtagagcgggatgacgcggccgccggacggaatgaccgggccgggttccagcggaatttcagggtggcggcgcgattgcagcttgtcgttcagcttggccggcgcgttttcgacttccacccactgctggccgttgaaatagctgtagttggccacgccttttttccagtcgtgctctagcaccaggtggatcttgaagttgacggcggcgttggagtgggggccgccggggttgccttgcgcggtgatcagaatccggccttcgctcggcggcatgatggtcagataggtgaattgccctcgcacgtccgagtgcagatccagcggcgggttggtggcctgggtgatgtgcgcggtgccggtcaccgtttcgccggcgctgttcaccagcagattcagttgcaggttctgggcgccgggcgcgccggtggtgatgatgtagctgaccggaaacagtccttcaagagcctgagtgttgcctgacatagagcctccgcaagtggacgatgatgccggaatcggcttagcgcctttccaggcgggaaatttcgttttccagctccttgagctgagcgcgaagatcgttcagatactgctcgctttgctggtggagttgcttcatctgggacaggctgccttcgctgatggcttgctgaatggcggcgccgtaaggcatgacggtgtggacgggttgtgcgctcatgttcgctttctctcggaaattgaaaaaagcaggggacgtgcgcggcaacccgcggtgaagtgacgggcgggcgccgggcagtgctttctgattagcagcttgcccggttcctgctctgcccttaagtacaggtagatggctggcgaggcttgggaaaaggcggggcgcgaggcggggtcagcttgggctggggacgcggcgcggcatcaccattcgtcgaattccggcggcgtgccgtccgacaacaccacgtcctgcatccactttttcatctggaactgcaggttgctggtgcccagcatcaccgccatcagcggggcgtgcagcggcgaggtttctcccagccgggccagcgtgcgttgcaggatggcgctttgctcttccagcgtgacgaaggccgcgctgtccgcggggtattggaagtcgcgcagcagtttggcgatggcgtcgatctgcgcctgcttgtcggcttgcgcgtccgaaagcgcgggcggaagttgctgcaacgccgcgagaaaggccatggccttggggtcggtgtcgtaatcgggccacttgccggtcgggcgggtctgcggcgtttcggatgcggcggcggccagcctttgctgcagagagaccggggcgtccggctcgggtgtcgcggccgaatagggcgatggggcggacagcggcgatatcattcagcgtctccttgccgggcggcggcgggagcggattccgattctgggttgcgttcccgctcccgcagcagatgcgccagcgaatcggccgcgatccggcggcagtcctcctgcaagccgtccagggcctgcaataattgccgcgatgccgattccacgtattgctccggctcgaattcggcggcttggtcggcgcagcgcatgacgaagcgcggctcggagtgatagtcgatgcgtatcgcgcctggccagtgctccgccaacagcgccatcagccgcggctgcagcgccttggcgcgcgacggcaactgcagcgtcagcacgtcgctgcgcgcgccgtcctgcgcgcgcagccattcgtccagcagcagcagcagcgtgtcggggtggtccaccgcggcggacagcatggcgcgggcctcggcgcccaatcgcagccgccactgttcggccagcgcgcggctgtcggcgagatgcgccgccacttggcccagcgcctcctgcatgccctgccggtagccttcctggcatgcctgctgccgaatggcgtcggcttcgcgccgggcttcgcgcagcaaaacttgcgcgtgctggcgcgcctggccgtccagccggccgagccgggcggcctggccaagccgctggctgcggatcaacacgccttcttcaatgcaggaacgatggggaatggggatgtctctgggcatgttgcaaggccaaggtcagtagcaagggatcgggcagcgcggcgggcctggcggccagcacggttgcgggcggaaacagcagcggcagtctttgtaccagcgcgcgcggcaactggccgctccaggccagcagctggccgtagcccgcggccagcagatcggcatgatccggcgcgcggggcagcgccggcgcggcgggtgcggccagcggcatggcggcaaaatcccgcgcccacggcggcaggcgcagcagcgcgccctgcctggccagcgagggccgcagcagctggcagcccatcaggtaggccgcttgcggcagccgcgcccagtggcgcagccattgccgggtggcgtggctgtgcggccccgccggccaggcggtgtccagccggtaggcggcgatcagcatgtcgttgacggcggcgcgctggccgccgccgcgcatctcgtccggcaggctcaggcgttcgcggtgcagatagccgagcgggtcgaacaggatggcacaggcctggctccccaggccggtgtcagccatgcgactctcccgcggcaggggcgggcgccgtcgccggcgcgggggggcggcggcgatgccagaaccagccggcagcgcccgccagcgccagcagggcggccaagcccgccagccaccaggcggcgccgctctggccttcatcgcgccgcgggccgggcggctgttgctgcgcttcgccgcggcgcgacagcaccacggagatgttgtcgtactccacttcggcgaagctgtttttcaggaaacgcttgatgttgttgatcatggcggcgggatcggcctcgctgtcgtacaccgccagcgcggagatgtgcatgggctgggctgtccggccggcttcgccgccgtccaggtcgtagctgacatgcacccgggcagacagtatgccgtccatggtctgcagcgactgctccaaccgctgttccagcgcggagtacagccgcgccttttccgcgcgcggcgacgacaccagcgagtcggcggggaacatctgcgccacctccaccctcgggcgcgacggcaggttgtagatgcgcagccagtccaccgcggcggcgaaatcgggctgggccacggcgatgctgaatccggtcttgccgcggtcggtcttgtcggcttctatgttgtggcgctgcagcaccgccaccacttcgttggcttgctgctgatccaggcccttgagcaggtctttttgctggcagccggccaacagcagcgccagcagcgcggctttcaggctggcgcgcatcatgagcgcagcaggctttccaccgcgcccacggtcttgcgggacagggtgctgatcatcgacacctccaggttgtaattggaggtgcgttgctgcagctcgaacagctcggccgggttggtgatgatttccggctgctccagcttttgcaggatggcgtctttttccatgccggcgctgacggccgagcgggaaaacgcctgaatcagccgctcttccagcgaaaccagccggtcttcgccgcgggcgaggtcgccggattgcgccagcgcgtgcagttgagaggcgccgatgggattcatgggtggctcctggggaggccgccggcgcgggccggcggcgcgggttaacggaagttctggatgatggcggcgtcgatgtccttgaacgccttcaccgcgttggattgcgcgttgcggtacaggttgtactcggacagcttgctctggtattgcgccagcagttcgggatcggacggcttgtccttcagcgccgccagcgcatcctccacctgtttgtgcatgttcttcacgccttcgtcgaacttggcggaggtttcgtccagataaccgctccagggaaaatcgatttttgccatagctagtgggtccttgtggtcaaagtggcttgggaaaataccagtggccggtttccatcttcacgtagccctggtcgccgtacttgaaggacttgcccttgagccagtcgtccttcaattctgtggcgaactgcacgtagcggctgccccattgccggtagtagccgtccacgaattggcgcgcgcgctgcagttcgccgtcgtccagcgcgccctctatcacgaaggtgacgctgtcggggtgcttgttgcggctgaagggcagcgcctgccgcgtcagccccgcctccgcctcgcgcgcggcggcggcgtcgtccatcgggacgatgtccacccgctcggcgtaaggcagctggcccgccaattgccggctgagcgccgccgtgtccgccgcgctcagcgcgctgcgctgcaggctggtccagagctgggggcggcgcgggtcgtccagctgcagccggtaataggccaggccgggccgggagtcggccagccagcggtcgatgcgttcgttttcccgccgcggattgatgacccgggccaggccgccgccgcgcagcagcgcctgccgcgcccaggcggcgtcgcggtcgtcggcggcggcgacgtagaacgcgccgtcgcgacccggcagcacctggaagcgttgcgcgtcgcgtcccagcagcgcggacagctgcgccgcctgtctttgcggcgtgtcccacagccagtaggcgccgccggccagcgccgccagcagaacgatggccagcgcggcaggccaggctggacggctggcgcggtccgggcgctcggccgccggcgcggcggcttgcggatgcagcagaatgtcctcagcccaggcttgccccggatgccgcagcgccagctccagctcgccgattttcagcgcccggttgagttcggccggataggcgtccgccgcatgctcgcccagctggcgaatggaagcccggccgtctgccgcctgcagttcgaaattgacgccgccttgcgccagcggcacgtacagggtgtcggcgggcagctcgggcagcgtcgcggcgctgtccagcatcggctcggggccgaccacgaacagggtccggcctgccggcaacgggaattcgcagccgcgcagggggctgttgagcaggcgcgccacgatggcggcgcttgcgctggtgtgggtgtcttctacggccatgggctctttgctgatctgcgttgttgccgccactgtagcgctggcccgtccgcgcttcctgatggaaagccgatcaaattccgatggcgcgatcagattcggcaaaaaaaagatggcggcccgcccacgcagggctgcggccgccattcaaggggtgaatcgttgtcagcggctggcgcgcagccgctggtagcgctgccacacctgatgggcgtagcgcatgcgcaaggttcggcgttcggggccgacgccggcgttgtaggcgcccaccgcctcccaggagtagccgtagcgtttcatcatgtccgacaggatggaggcgccgacgatcacagacagacaggcgtcgcccaacagccgcttctcgtccacgcccagctggcgcagccgcggcaggtgcaggctgttgatttgcatcaggcccaggtcgcggctgccgtcgcggttgcggccggcggcgtcgggccgtaggccggattcctgctcggcgatggcgtacagcaggtcgggctcgatattgaacatccggccggcctgctcccagcagtcggcatgggcgggcagcgcgcacagcagcgcggcgccggccagccaggcgcggctcacgcggcctccggcagcggctgctgaaacagcgaggccagccgcgggtcgtgccgccaggcgcgcagccacaggtagcgctcggcctgcaattgacccagcaattgcagcgcggcctcgcggccgtgtagggccaggatcagcggcagcaggccggagcggacctggcggctgtccaccttggccaggaagtccagcagctgcggccgggcggcttcgccctggctgcagtggcgcacgtagcaacagttggccgccagcaggccgcactcctcgccggaggcgcgcaccgctgccgccagctcttctgcctgggcgtgctggccttgcaccgccagcatcagcgccagcatgctctgcagcaccgggtggtcctggccgtattggcagagctggcttttgcccagcgccaccgcgtcgtcgacgcggtgctggcaataggtaagccacagtttgaggatgccggcggcgatgcgggaagggtcgcgcgccagacaggcgtccaccgcctgctgcgcctgctccagccggttggacagaaacaggtgccaggcgtggtagtagtggatgtccagcgaatccggcgccagcaggcgcgcctgctcgaacagagcgtcggccaccgcgatttgcgcgcgcatgctgctgagcagggccagcaagcccatggcttgcggatggcccgcttccagcgcgatcgccttgttgactgcctgctgcgcctcctccagcgccagcgcctggtcgaacaagcccagttgagccagggtcaggtagcactcggccaggctgcagtaaggcagcgcgtggctggggttgccgctgacgcactggtgcagcatggtcagcgcctggcgcaggctggagggggtgtggcgctgcagttggtggcggctgttgaggtaggccacggcgaggtccagcgaatccagctcgctggcgttgccctgtttccagcgcaggccgggaatgcgttgcggcagcaggctggccagccggctgtggagcgcggcgatgggctggcccggacccagctccatgctttcgtgatgcaccagctggtggccgtcggcgcgcaccagctcgatctgcagttgcgacgcgccgccatggcggcgcacttgtccggccaggtagtagtcggggcgcagttggtcgatcagcgacatgatgtcggcgacgtcgctgcaattgcgggtgatggtggccggcagcacgatcaggccgaacggcgaatagcgcgacaggcattgcaccagcgccgcgtgcagctccagcgcgtccagttggccgtcggtgcgaaagggcagcaccgccatcgtgcacttttccgcgttgggcgtcgggcgcgacaccaccgccaccggacggcagaaacggtagcccttgccatagacggtgtcgatgtagcggttgtccttgccttccagcaggatgcggcgcaacgcgtagatgcagcgggtgagcgactcctcgttgacgtcgccgtccggccagacccggtccagcagcgagtccttgctcaccagctcgccagcggcttccagcagggcggtcagcaccgccagctccttgggcggaatgctgagctgctgttcgcggtgaaccagcgcgccgtcgaagcgcaggacaaaatcgccaaagacgaattgccgattgatgaagccatcgttgtgtaacgccatcttcagttcctcttgcgcgcggggcgcgacaaccgtgcgggcgggccgcaggaatcgagtcgaccgccgccgcgcctgctgtttccccgcagcgtcgcggcatgtcgcgtgttgttatctggatgtgttcgagtgatctgtgccggttcttgtatttatcttcgcatcataaaaacggatagtgcatggtacttatgcatgcgcggatgcggcttgcaaaaaacgtccagagcgatggcgtggcgaggaagagtggcggtcatctctattgaattgaatgacttgccgccggttggatcacggaattcaacatttagagtaggaatactacgcgagggtctgcttgctacaaatgggaaaagtctgaaaaacgaccgggcgcgaagggcgttttatgcaagtcgcggcgcgcggcctgcgttaatttgacgctgggccgcctgcatggatgcgggacgcgccgatcgcaaactgtcgcccgggccaagccgggcaggagtcgagaacatggtgaatggagtgtccggggccgccaggccgtatccgttggccgaagcgcggcaggcgtcccacggcgcggcggcgtccggcctggcccagcgctgccgcggctgcggcatgtcgccgcaagcgcggccccagccggcgatggccggcagccaggtcggcggttttcaatcttgcctggacgggctgcggcgcgatctggatggcgccggcgccatgctgcgccagctgtccggcgacgccgggcttccgtcgcgccagcaagcgcaggcggggcagttggcgcagcggctggatggcttgagccaggcgctggaacggggcaaccggctggcgttggcggccagcctgatcggcgcgcgcggcgcctgaggagaacaccatgctggatgcaatcggcgcgaacggcgccgccacgctgcgcgggtttcgcgcattgccggacggcgaagccgccccggcggcgaacttggggcgggcgctgcgcggcgcggccggccggccggagaggcgcgcggccatgccgcgcggggcggagatcaaactggcggatgccgaactgcgcctgcagcgccagggcatgcgcgaggtgctgcgggcgatgacggacgaagcgcgccgcctggccgagcccgcgccgcggccgcgctgggcggcgacgctgcggctggggaatgccagccatcgcctgacgtcggacagcgtggccattttgcagaacctgcgccaggcgctgcgcgaaggcagcggcgacgcgctggacatccgcgaatgcgcgaagctgtcgctgcaactggagaagctggcggaaaaattgccggccgacagcccgctgggcgagctgagccgccgcctggccttgcaggggcaggccgcctgggcgcagctggcgcgcgccgatgtcgaacggcaattgctgccgcagtttttgcgtttcgatcagccgggagcggccagcgaaaggcatctgggcgtatcggtgggcgtcggcatcggcctgggcgagggcggcctcggcgccaaggcgacggtaggcctgggcgcgaacctgagccgcggcatggataacgacgacgagggtttcgtattccagaaccgcggccatgcggtatcggttcaggccggggtgagggccggcgtcggcgcggccacgctgtcgggagcggcggaagggcggcgccaggtcacccgcttcaccgaattcaacagcgccaaggcatttgtccatctgcgggccgagcaactggggcacggttcgcgccgcgaaacgctgggcgtcagcgcccgaaccgtggtgggcgcgctgatccggctgttccgccccggacacggcaacgagctgcgccattaccaccgcttgcagcaacaggcgggcgatcagcagcagcgggtggcggtgctgctgggctggctggggcggcgcgatgcttccgccgcgctgcctggcgcgcgggtgccggtgttgccgggcggcgaatcggtggctatccgcggcgccgtcagcgcgcgcgcggcggcggtcggtttgagcgccggcgtcggcgcggcgctggagcgcatcgacatccgggccgacgcgctgacgccgttctggcagggcgtcgcggccgaagcgggcgcggcgcgcgacccagtggtggcggcgcagcggctggccggcatcgagcaaaaggcgcaggcgctgttcgaccaagtgggcgacaagccgggcgcgcggccgctcagccgtttgaccggcgggctgcggctggcggattgcccgcccgaggcgttgaagtcggccgtcggccggctggcggcggagttcgagcatttctgcgcggtggcgcggcagctggatgccggcatcggccgccgcgaaggcggcgcgcaggtggaaaaatccattctggccagctggcagggaaaaagccgcgaggacgcgctggcgaacatggcgctggcgcatgccgcgctgttgctggcggcggggcggcgggagggcgcggacgatgcccgcgcggccttgttggaagccgcgcccggcttgtacgcgccgccgattcgccatgacgccgcggcgctggccgagcgggtgagcttccgcgacaccctggctctgcagatccgcgaccgcagctacgcgctggacctgggcggcggcatcggcccgctgggggtgaaggcggaagcgtccttgaccgagcgcgaacgggttcatcccaatccggcgcgcgctggcagctacaaggatgtgcgcgtcaccttgtccggcagcctgggcgacgctggcgcgctggacaagctgaaggacgcgctgctggcgcaactggcgccgcatggcctggccgatcagctgccggcggcgttggcgggcgcgcagtcgcaattgagcgcgcagaccggcgcgggcgtcacgctgctgctgcgcttctaccagccgcaataccagcgccaggccgacttcccggccgcagccgccggctaccggctgcaactggccagggtgagcgccagcgtggacggttcggccgcgctgtccggcggcgtgccgttgcagccgggcgtgtcgctggagctgggtttgagcgccggagcgtcctcaagcgcggtgttgcatgagcgttggggcgacaacagcctgagcgcgccgatgatgcattatctacacctgcaggcggtgggcgagcccgagcgctggccggcgctgcgcgagtcgcagcgggaggcgctgtcgggcctgttccggcaactggccgacgacggcgccgccgtgcatcaagaggcggggtattttctggcgcgccagccgcaagacggcttcggcgagcgcttcttcgccgcgatgcgcgccttcgcctccggctcgggcggcttcgacgcggcaggcgcggcgctggaagccctgctgcagcggcaatacccgctgtggcaggcggacaagctgtccttccccggcctggtggagctgccgctgccggcgtgagcgaaccgccatgatggttttgccggcccgcttgagcgctttttgtaagcgccggcgggccggctgtattccaatattcctggtcagttcgttgatcccaaccaggagccgtcatgcacatttccagtcttcaaccatcccgtccgttgtcttcttcgtccgcagccgatcaggcccaagctgtccgcagctttgcccaggtttacgacaaggccgacttcaagccggtgccgaatcagatccacatggtgtgggtgggttcgcaacccggccagacccagcaggactacctgcgccaatgggcggccaagaatccgggctctgaagtcaatctgtgggtggattccaagcagttcggcgcctacgccgccaaccgcgaggtgcgccagcaggtggacaagctgttccccgatgccggcgccttccaggcggaaaagctgttccgcggcctgttcagccagttggccgccacgctgggcaaggaagacggcgccttggggcgcgccgcgcagaagcaggcgctgagcgaattgaacaaggaattggcggcgccggggaatgaggcctggcgcgaggcgctgctgccgcagggcggcaaggtgaccggcgacaatgccgccgccgcgctggatgccttccgccaattggttcgcggcaacgacgagaaattcctgttggccgaccgcctgatcctggaccagaccgtcaaggcctgggaccgctgcgccgccggcgccgagcgcgacgtcgccgcgctggagcgcctgcaggccggcttcgccgacgcgcccaatgtgaaagtgcgcgacctgagccatgccggcgatatccagctgcgcaaccgcgacgcctaccagcatgaaatcatcggccgcaacggcgcgtatccggcggcgtcggacatcgcccgctatgaaattctgcacaactacggcggggtgtacgccgatatcgacctggagtgcacgcagcccttggccggcgcgttgtccgcccacccggacctgatgctggtgggtctggccgaaggcaagcgcgaggccagcggcagcgccaccccgtatttcgccaacgcgctgctggccagccaccccggcagcaagatgctggacggcttcatcgacaagatcggccgagactaccagcagatgaagggcgcggaattcgccggcgaccgttacttcagccgcgccaacaagagcaccatcgaaggcaccggccccaacgcgctgcgcggccatgtcgacgccgtgctgcgcgaagccgagggccggccggaagccgcgcgcggcgacgcgcaatcgctggcggagcgcatctggagccaggacgacacccgcaaccatgatttctgggcggcgatggactcccacttccgtttccccgacggcttggtcaacttcgaaaccgaagagcagcagcaaagcgcgaccaagggcatggcctgatggacgccggccgggcaatgtcggcccggccatcagattcgcatcaggattcgcccgggacgctgggcgaaactgtccgtcatccaagcacgagcccgcaagcgggcatggaccgatgacagataacgatgtgttgaatccgctggaaacattgggcgcggccgccagtcgcggcgtggcgtcccaggaggcctggctgttgcaaccgcgggagggccgggccgcgcgcctggccctggactgggcatcgggcggcgagatgctggagctgcccgccggctggcgcggcctgctgctgctggaccggctggagctgaccgtgctggacggcggcgtgagcttccagcctatgcggctcgaggcgctgaccaagctgctgtccttcgtcgacgaggcgcgggacgccgagcagcaggccagcgaatgccgttgcgcgctgctgccgttgggcgaggacgaagtctggaccgaccgccgcggctgcgagtactggtttttgcgccaggtgctggcgccgtccgagccgttccaggcgctgttgtccttgctcaggcgcagcgaaagctactggctggtgcgcttcctgctggcgcagtccgagcgcggcgacaagctgcaagagctgggcgaacgctacggcgtgtcctactcgcactttcgccgcctgtgccgcaatgcgctgggcggcgcggccaagaccgagctgcgcgactggcggatggcccgctcgttgctggacgtggtggaggggcgggacagcctgacccaggtggcgctcaagcacggctatgcgtcgtcatcgcatttttccaatgaaatcaagggactgatcggcgtttctccgcgtgggttgtccaatatcatccagttggccaccaaatgaacaagtctcttttgctcgcagcctgtctgggctgcgccctgtcgttgccgccggccagcgccctggccgcgccgccggccgaacgcgccggcgaggatgccggctatgtcgccaggaaagacagcctgcgcgcctttttcgacgcgctgtcatcgcggctgaagaagccggtgatcgtcagcaagctggcggcgcgcaagcaagtcagcggcgatttcgacctttccagcccgcaggcgctgctggaaaagatgtcgcagcagctggggctgatctggtaccacgacggccaggccatctatgtttatgacgccagcgaaacccgcagcgcggtgctgtcgctgcgcaacgtgaccttgtccgctttcaacgatttcctgcgcaagtccggcctgtacgacaagcgctacccgctgcgcggcgacggccgcagcggcaccttctacgtgtccggcccgccggtgttcgtcgacctggtgagcagcgcggcggcgatgatggacaagcagagcgacggcctggacctgggccggcagaagataggcgtggtgaagctgaacaacaccttcgtcagcgaccgcaattacgagctgcgcgatcagaaaatctccatccccggcatggccacggtgatagaaaagctgctggagggcgaacagaagccggtgcgcgacgtggcggccgcgccgccggcccgccgcggcgacatcccgcccatgcccgactttccgggcgcggccgacctgaagccgccgccgtacgcggccgggctcagcctgccggaggcgctgaagcaggaagccgccgccggcgacatccgggtgatcgcctatccggacaccaacagcctgctggttaagggcaccgccgagcaggtgcgcttcatcgagagcctggcgcaggcgctggacgtggccaagcgccatgtcgagctgtcgttgtggatcatagacatgcagaaggacgacctggaccagttgggcgtcaactggagcggcagcgtcagcgtcggcaacaagctgggcgtggccttcaaccagtccggctcgctgagcacgctggacggcacccgcttcatcgcctcggtgatggcgctgtcgcgcgacaacaaggccaatgtggtgtcgcgcccggtggtgctgacccaggaaaacgtgccggccatcttcgacaacaaccgcaccttctacgccaagctggtgggcgagcgcagcgtcgatctgcagcatgtcacttacggcacgctggtcagcgtgctgccgcgcttcgccgccgacggccagatcgagatgtcgctgaacatagaagacggccgcgaaacccgcgcgccggactattcgcaggacaacaaggacgccggcctgccggaagtgggccgcacccgcatcagcaccgtggcgcgcgtgccgcagggcaaaagcctgctgataggcggctacacccgcgacgccagcgacaaggagcaagccaaagtgcccttgttgggcgacttgccgctgctgggcggcctgttccgctatcagcgcagcaaccagtccaacacggtgcgggtattcctgatccagccgcgcgagatagacgagccgctgatgccggacgccagcgatctgtcgggcggactgcccggcggcgccggcgtcgatgccgacccgctgcagcaatgggtgcgcggctatctggaccgcgaacagcggaacggcgggtaggcggcgatggaaatcaaccaccgcgcggtgttcagcataggcctgcgctcccccaagcagcaggcccggcaagaagcgcagcgcgacgccgtgcgccagagcgaggcgaggcaggccgaggcacagcaggcggcggaggacgccagcccggcggccgagctgcagcgcttcgcgcagtccagcgatgagatggcggcggcgctgacgatgttccgcaaccgccgcgactacgacaagaagcagggcggtctcgccgacagcttcgagcgggtgctggacgaagaggcgctgcccaagtcgcgccagctgctgcaagtggccaaggcgcacgggctgacggcggaagagctgctgcgccaggcgcgcgcgctgtttcccgacgacagcgacctggcgctggtgctgcgcgaactgctgcgccgccaccagctggacgaggtggaacgcaagcggctgaaggcgctgctcaagcaggtggaggagcaggccgcgccgcggccgttcaaggccggcatcaattgcgcgctgaaggcgcggctgttcggcaaggcgctggacctcagccccggcctgctgcgcgccagctaccggcaattcctggagagcgacgcctccgaggcggaaatctaccaggactgggtggccagctacggctgccagcggcgcgcggcggtgctggatttcatcgagggcgcgctgctggccgacatcgacgcgcaagaccccagctgctccgggctggagttcggccatctgttgggccggctcagccagctcaagtcgctgcgctcggccgacgcgctgttcgtcggccggatgctggccaatccgctggcgcgccgcttcaatcccgccgaagccgactggctgctgttgctgctgtcgctgctgcagcagccgcaagacgtcgacgcgctgctggccgacacggtgggcgaggccgcgctgctcagccgccacgccgatcattccgcgctgttgcaaacgctgtaccaggcctgcaaggcgttgccccccggcctgttcgccgacgaagcctggcagccggcgctgctggaggagttccgccggctggccggcgtcgcctaccgccgcgaactggcggaaaaacggcgcgaaagttaaccgcccggcgcgccgcgccggcttaccctggatggagccctggtgttgaattccttgctgaacggcgcgcgcacgcggccggaactgctgatcttgctgttgatggtgatgatcatcgcgatgctgatcatcccgctgcccacctatctggtggacttcctgatcggcctgaacatcgtgctggcggtgctggtgttcatgggctcgttctatatcgaccgcatcctcagcttttccacctttccgtcggtgctgctgatcaccacactgttccgcctggcgctgtcgatcagcaccagccggctgatcctgatcgaggccgacgccggcgagatcatcgccaccttcggccagttcgtgatcggcgacagcctggcggtgggcttcgtggtgttctccatcgtcaccgtggtgcagttcatcgtcatcaccaagggctcggagcgggtggccgaagtggcggcgcgcttctcgctggacggcatgcccggcaagcagatgagcatagacgccgacctcaaggccggcatcatcgacgccgacggcgcgcgcgagcgccgcagcgtgctggagcgcgaaagccagctgtacggctctttcgacggcgcgatgaagttcatcaagggcgacgccatcgccggcatcatcatcatcttcgtcaatttcatcggcggcatcgccgtcggcatgagccagcacggcatggacctgtccaccgcgctgtccacctacaccatgctgaccataggcgacggcctggtcgcgcagattccggcgctcttgatcgccatcagcgccggcttcatcgtcacccgcgtcaacggcgacggcgacaatatgggccgcagcatcatgagccagctgctgggcaaccccttcgtgctggcggtgaccgcggtgctggcgctggcggtgggcatgctgcccggctttccgctgccggtgttcctggtgctggcggcggcgctgggcggcttgttttactacaagcggcgccaggcccgcgcggcaggcggcaagcccgctccggccgccagcggcggcgccgagccgacgccagccgcccgcgagggcggcctgggcctgatcggcaacctggacaaggtggcggcggaaaccgtgccgctgatcctgctgctgccgaaaagccggctcgccgcgctggagtcggcgcaactggccgagcgcctgcgcagccagtttttcatcgactacggcgtgcgcctgccggacatgctgctgcgcggcaacgacaagctgccggacaaccgcgtggcggtgctgatcaacgagatccgcgccgacgagttcgccatccatttcgacctgcagcgggtggtcaactactccgacgaggtggaaacgctgggcatgcagccgctgctggccgacggccaggcctgggtggcgccggccgacggcgacaagctcgccacgctgggctaccagctgcgcgccgcgccggacgagctctaccactgcctggccgcgctgctggcgcgccacgtcaacgaatacttcggcgtgcaggaaaccaaacacatgctggaccagctggaaggcaaataccccgacctgctgaaggaagtgctgcgccacgccaccgtgcagcgcatcgccgaggtgctgcagcggctgctggccgagcgcatttcggtgcgcaacatgaagctgatcatggaggcgctggcgctgtgggcgccgcgcgagaaggacgtgatcaacctggtggagcacgtgcgcggcgcgctggcgcgctacatctgccacaagttcgccagcggcggcgagttgcgcgcggtgatggtgtcggccgaagtggaagacctggtgcgcaaaggcgtgcgccaaacctcggccggcgcctttctcaacctggagccggcggcgtctgacgaactgatggacctgttcgcgctgggcctggacggcctgggcgtggcgcaccgcgacatggtgctgctggcctcggtggacgtgcgccgcttcatcaagaaactggtcgaaacccgcttccgcgagctggaagtggtgtcgttcggcgaaatcgccgacagcgtgtcggtgaacgtgctcaaaaccatctaatagaggaggcaagcttatgttcgcactggatatcgcccaactggtccgctcggcgctgcgggaaagcggctgcgacccggccatgctgggcgagctggacaaccactccaccatcgcgttggacctgcatgagctgcccagcatccacgtcggcgcgcaggacgccgaggtctggctgtgggcgcgcctgaccgagcacggcgaagcggcgctggcgcagcgcggcggcgacctgctgcaagagctgctgcaaggctgcgactatgcccgcggcggccaattgcagctggcgttgaacgacggcgcgctggagctgaaggcgttggtcaatccggaattcctcgccgacggcgcgcgtttttccgaggcgctgaacggcttcttcgacagcctggagcgtttttgcgagttcacgctgcgatgaagccgccgcgcctgctgcgccggctggccaacccgcagcgcctgtccggccccattctggaagccgccttgcccggcgtggcgataggcgagctgtgcgacatccgccgcggctggcaggaccgcgaggtggtggcgcgcgcccaggtggtgggcttccagcgcgaacgcgcggtgctcagcctgatcggcgccgcccgcggcctgtcgcgcgaggcggtgctggcgcccagcggccgcgcgatgtcggcctgggtgggcgaggcggcgctgggcgcggtgctggacccgacagggcggatcgtcgaacgcttcgcgccggccgagggcgccggcggcgaagaacgcgccatcgacgccgacccgccgccgtattcgcagcgggtgggcatacgccagccgctggccaccggcgtgcgcgcgatagacggcttgctgacctgcggcgtcggccagcgcgtcggcatcttcgccgccgccggctgcggcaagaccatgctgatgcacatgctgatcgaacagggcgacgccgacgtgttcgtgatcggcctgatcggcgagcgcggccgcgaggtgaccgagttcgccgaatcgctgcgcgcctcgccgcggcgcgggcgctgcgtgctggtatacgcgacgtccgacttttcctcggtggaccgctgcaacgccgcgctgctggccaccacggtggcggagcatttccgcgaccagggcaagaaagtgatgctgttcgtcgattcgatgacgcgctacgcccgcgcgctgcgcgacgtggcgctggcggcgggcgagccgccggcccgccgcggctatccggcctcggtgttcgacagcctgccgcgcctcttggagcggccgggcgccacccgcggcggcagcatcaccgccttttacaccgtattgctggagagcgacgacgagccggacccgatggctgacgagatccgctccatcctggacggccacatctatctgagccgcaagctggccggccagggccattacccggcgatagacgcgctcaggagcgccagccgggtggcgggccaggtgacggacgcagaccaccggcgcagcgccgccgcggtgcgcggcctgatggccaggctggaggagctgcaggtgtttctggacctgggcgaataccggccgggcgaaaacgccgacaacgaccgggcgctggccgcgcgcgcgccgctgcagcgctggctgcgccagggcgtggacgaaagctcgccgctggcggacaccctggcgggcctgcatgcgctcgccgattgagccggggccgctgttgtcgcgttgccaggccgaacagcggcgctgcgacagcgaactggcgcagctggcgcgggaggacgggcaactggaagcgcgccagcgcgatctggacggccagggcgaaggcctgcgccggctgctgctggcgcagcgcccagccggcgcggccttggaccgcggccagctgttcgcgctgctgcgcaagcaggcggtgctgcgccgccagctgcaaaacctggacttgcagcgggagcaggcgcgcgaacagcggctgcagctggcggagcggcgcgagcggcaggcggcgctgcgccgccagtggctgcgcaaggaagaaaaataccaacgctggatgcagctgcaacgccggcgccggcgcttgctgggcttgcgtcaggaagaaatcgaacaagaggagatgacgacatggcaagcgtgatgccgacaagcgcgccggcggcgatggcgccggcccagcaagcggaagccgagggcgtggcgggcgcgttcgcgcggcaggccggccggctggcgcgggacgaaacggggggcgagcgcgacaaggacaaggacgcgttgcctgaaaccggcgttttcgcgctgttgccgccggcgttgccgccgctcggcctgccggcgcatggccgccgcgccgccgacgctcagcccgtggcagcgggcatgaaggcggcgagcggagcggtggagaaagaggcgcgccgcgacggtggccgcgcatcgctggagcaggcgctcgccgcggcggcgaaagccgccgcccatgccggcgcggccgcgccgcagccgggcctgaaaccgcgcggcaaggaggccagcggtcccgccgcgcatggcgagggtggcctgaaggagaaggcgcagcctgcgctgcccgccgcgccgctggccgaaccgtggcggcttgggcccttgtcgcacgagcacttgcgcgcggctttgcccgccgcagccggcatgccgcccagcccgccgcagagtccgttgtctgacctgccggcagtcccgtcgcttggccggctgaaggatgagccgcacaagccggttgcggctgaagcgtcggcgcagccggccagcctgcccgccgcgccgcggaaagaggcggaagcaggtctgccgccgcgggcggaaacgcctcggccgcaaacgccgggcatggagcgccagccgccgcaaccagccgcggcgggggagccgcaagccggcctgacctatcgcttccagcgctggggcggcgagcattcggtcaatgtgcagttgccgtccgggccgggcgccgcgcagctgacgctgcagccgtccgacagcctggtgcagcagcgcctgagcgagcagtggcagcatggcgacccgcagcgctgggagctggcgcgggacggcggcgagcgccagcgccgcgacggccgccagcctgagccggaggaggacgcgtgatgttgaaactgcggcgagtggagggcgaaacgctggccttgcgccaggcggccgaaatctgggccggccagggctgggaggcggagatcgcctatccgccgcgccatggccgctggctggaagtggcggacgaggacgggcgctggcagggctggctggagccgcgcgcctggctcgagagcatggcgccggatctggcggtgctggccagcggcgccggcgcggagcggcaggccggacgcctgatcgccgccagccccgcgccgctgcattggcctatgcccgatctgccgcgcggacgggtgcgcgccggcgcggagcgggatggcggcgaactgccgcagcggccgctgttgcgagtggctacgccgcaagggccggtatggctggccagggtggaagcgccgcggcccgccgccatgccggcgaggcgtttcgactggctgtctgcgccgctggctttcggcctggggcatagccacatcagccaagccctgctgcgcagcgtgcgcggcggcgatgtgctgctggtccagcaaacggcgtccctggtggcctgccatggcaggacggtggggcgttatcaacgatccgatgaaggaatcatcatggaatggcaaatggaagaggcggcggagcgggatgagccggcgctggccgatatcgaacaattgccggtgcggctggagttcgtcttgcagcaaagccgggtgacgctggccgaattgcggcagctgtgccagggccggctgctgccgttgcaggccggcgccgagcgccaggtggaggtgcgcgccaacggcgccttgctgggccgcggcgagctggtgcaactggatgggcagctgggcgtggaagtggcgcagtggcgggacgggccggacgatgtcgaatgatatttcgctgatcgcgctgctggcgttttccacgctgctgccgttcctgatcgcgtcgggcacctgcttcatcaagttctccatcgtgttcgtgatggtgcgcaacgcgctgggcctgcagcaggtgccgtccaatatgacgctcaacggcatcgcgctgatgctgtcgatgttcgtgatgctacccgtcgcgcagcaggcttacggttattaccaggaagagcgagtcagcttcaccagcgtggagtcggtgagcaacttcgtcgaaaacggcctggacggctaccgcgcgtatctgcagaagtattccgacccggaactgacccgtttcttcgagaaggcgcaggtcgaccgcgccgagcgcgaaaccggcagcgccgcggcggacgaacagccatccatcttcgccttgctgccggcctacgcgctcagcgagatcaagagcgcgttcaagatcggtttttacctgtacctgcccttcgtggtggtggacctggtgatctccagcatcctgctggcgctggggatgatgatgatgagcccggtgacgatatcggtgccgatcaagctggtgctgttcgtggcgctggacggctggacgctgttgtccaagggcctggtgctgcaatacctggatctggcgacgtagcgggcgccggggcggcggcaaatggcgctaccggtttgaacggagcggagagtccgctgcgcgggcgatgattttcatggccggggctgcccggcaggcaggtctgggagctgtctcgccagccccctgacaaccccagtcgaccccgaccgcgcggcgaaaccccgcccccgcatccctcgccaaggcgccgccgaactcgcgatttgctagcgtcaaatcgctcagacaaacggcggcttaaaaccttggcgagggatgcgcggacggcttgcgctggcggggaaggcgggagcgtcggatgcgtcctgcccttaggctcctgcgtgcacagtttttgttgattgaaaggttttcctatgaacgacctggttttcgccggcaacaaggcgctttacctggtgctgctgatgtcggcctggcccatcgtggtcgccaccgtgatcggcctgctggtcggtttgtttcaaaccgtcacccagctgcaggagcagacgctgccgttcggcatcaagctgttcggcgtcagcctgtgcctgttcctgctgtccggctggtacggtgaaaccttgctcgccttcggccgcgaggtgatgcggctggcgctggccaggggctagccgatgccgttcgggctgtttttcgagatccacggctgggtggccgcggcggcgctgggtttcgcccgcgtggcgccggtgtttttcatcctgcctttcctcaatagcaatgtgctgaccggggtggtgcgcacctcggtggcgatgctggtggcgctgggactgtggccgcacgcgccggaggcgctgccggccttcgacgcgctgtcgttcgccgcgctgatcgcgcgcgaggcgacggtgggcttgctgctgggctgcctgctggcctggccgttctgggtgttccacgcgctgggcagcattatagacaaccagcgcggcgcgacgctgagcagcagcatagacccggccaacggcgtggacacctcggagctggccaatctgttcaatctgttcgccgccgcggtttatctgcagggaggcggcatggcgctgatgctggatttgttccgcgaaagctaccgcttgtgcgacccgctgggcggcggcatgccggcgctggcgccgctgctgggcctgctcaatcaggtggtgtccaaatcagtggtgctggccagcccggtgatggcggcgctgctgctgaccgaggcggtgctgggactgttgtcccgcttcgcgccgcagatgaacgcctttgcggtgtcgctgacggtgaagagcgcggtggcgctgctgatcatgttgctgtatttcgcgccggtgctgccggacgcgctggcgcggctgtctttccagcccggcgccttgtccggctggctgccggccggaggctgagatgtcgaacaagaccgaacagccgacgcgcaagcggctgcgcgattcggccaagaagggccagtccttcaagagccgcgacctggtggtggcctgtctcaccctgtgcggcgtggcctatctggtgtctttcggctcgctggtggagttgatgggcgcctttcgccaggccatcgccggcggcttcagcttggacatggcgggctacgccaagacggtggcctggctggggctaaagctgctgctgcccattttcttgctgtgcgtcgccgcctcggcgctgccggccttgctgcaaagcggcttcgtgctggccagcgaggccttgaagctcaatctgtcggcgctcaatccggtcaacggcttcaaaaagctgttcagcctgcgcacggtgaaggaggcggtgaaggcgctgctctatctggccagcttcgcggcggcggtggcggtgatctggcgcaagcacaaggagctgctgttttcccagctcaacggcagcccgctggacatggccggcgtgtggcgcgagctgttgctgtcgctggtgctgacctgtctgggctgcatcgttctggtgctgctgctggacgccatcaccgagtatttcctgttcatgaaggacatgaagatggacaagcaggaagtgaagcgcgagatgaaggaacaggaaggcaatccggaaatcaagtcgcgccgccgcgaggcgcatatggaaatcctgtccgagcaggtgaagtccgacatcgagaactcgcggctgatcatcgccaaccccactcacatcgccatcggcatctacttccgcccggaagtcgtgcccatccccttcgtgtcggtgctggaaaccaaccagcgcgcgctggcggtgcgagcctacgccgagaaggtcggcgtgccggtggtgcgcgacgtgccgttggcgcggcggatcttcgccggccatcgccgctattccttcgtcagcctggaggaggtggacgaagtgctgcgcctcttggtctggctggagcaggtggagaacgccggccagccggagccggacgacaacccgccgaacgccggatgagcgattcctgaatgtttgcccgcgcgctccgcgcttaaatgattccgaccgcttgccacacaggcggttgctagccagctctgccgggttggtgaccttaccaggagcagatatgaacgcgaatgacaacgtcagcgacgaccgctttgcggagatggtctgggaagccgtgagcggaggcgccacgttgaaggacgtgcacgggattccgcaggacatgatggaaggcctgtacgcgcacgcttacgatttttacaacaagggacggctcgacgatgcggagacctttttccgttttctctgcatctacgatttctacaactccgattacatcatgggcctggcggcggtttgccagctgaagaaacagttccagaaagccgccgacctctacgcggtggccttcgcgctgagcaaggacgactaccggccggtgttcttcaccggccagtgccagctgttcctgcgcaaggcggccaaggccaggcagtgtttcgaactggtgtgcgagcaaagcgccgacgaggcgctgcgcgccaaggcccaggtgtatctggacactttgcaggaaaccgaaaacgggcagtcccgcgagcaggaaaaggagcaggcatgagtgacgcaggcaccataggcagcgcgtatctgcgcaatcccggccttgccggcgcggctttcgacagcgtgcgcaaggacggttcctttctcgacgccgccgacaaggcgctgaaggcggtgctggccacccgggccggcgaaggtaagccgacagtgagcgagcgcgatctggccaccccggcgctgagccagcccagccccaaggcccagcgcgagctggacggcagcggcaaactgacgctgctgctgggccaactgatgacgctgctgggaaatgtctccctgtcgcagctggagagccgtctggcgacctggcgcgcgatgatggagtcgcagcaggcgatgggcaatcagctgtcgcaggaattccagcaggcggtggccgaatcgcaggccgccaccgaggccttccgcggcgccgaaggcgagtatgaaaccgccaaggcggcggccgacgccgcgcagcagaaggccgcggccgccaaggcgaagctggaggcgatgcagccggacgacccgggctatgccgacgccaaggcggccagccagcaagcggcggccgaggcgcagctggcgctgcaaaaggccggccaggcgggcgagctggcggagaaagcccgcctggtggcggtggacaaggccaagcgggcggacgagctagcgggcaaggtgcagggcgccaacgtcaacaccgacgcggcccgcaagggcgcggaagaccacctgagcaatgtcggcaagctgaccatgctgatggcgatgttctccaagctggtgggcgagaatagcgaaaacagcctgaagaacgacctggccctgttcgaagcgatgcaggaaggccggcaaaaagagatggacaagaaatccgccgagtaccaggaagaggtgcgcaaggcggaggagctcaaccgcgtcatgggatgcgtgggcaagattctgggcgcgctgctgacggtggtcagcgtcgtggccgcggctttcaccggcggcgccagcctggcgctggccgcggtgggtgtcgctttgatggtggccgacgaggtggtgaaggccaccaccggcgtgtccttcatggaagaggcgctcaagccgctgatggaaaaagtgctcaagcccttgatggagctgataggcaaggcgctgagcaaggccctggaaagcatgggggtggacaagaaaaccgccgaaatggtgggcgccatcgctggcgccatcatcgccgcggtggcgatggtggtggtgatggtggtggtggccaccgtgggcaagggcgcggccagcaagctgggcggcgcgctcagcaaattgatgggcgataccatcaagaagctggtgcccaagttgctgaaggaattggccagcaacggcggcaagctgctcagccagggcatgcagcggctgggcaacagcctgggtctgcgcaccgacgagctgtccaagcagctgatccgcaacacgctcaaccgcgtggtggtgggcggcgaggtggtcaatgccgccagccaggccggcggcggcgtggcgcagggcgtgttcatgaagaacgcgtcggaagcgttggcggatttctcgctggcgcgcgcctcgatggagcagatcgagcaatggctgaagcaggcggtggaagccttcggcagcacccagaaaatcacccaggaactgaccgcggccatgtccgccgcgctgcagcaaaacgcggaagccagccgtttcgtgctgcgccagagccacgcctgaaccagaggagccatagaatatgatcagcctgaatcacagcagccccctcgccatttccctcccgaccggcgccgacagccccaaggcgcgcgccgccgacggcctgatttccgtcgccaccctgctgccggcgctgcgcgccagcggcgaaaccggccgcgaactggccggcgcgctggcgggccagcccgaactcgccaagccgcaaggcatgctgaagcctgaggacgccggcgcgctgcaccgctggctgagcggcaagctggacgaccgccagttcaccgccggcatcgagcagaccatgggcaagctggagttgctcatcgacaaggaattgaaagcgcgcggcgacgaggccaaggacccggccttcgacatcagcggcatgtccacccgcatggccgcgctgctggcgcaggccatcgtgctgatgtcggcgctgcgcaccgccgacagcgccctgagcagcaagctgtcgcaggtgagcttcgacgccaccaagagcaccgcggcttccatggtgcgcgagggcctgtccaatctgtccagcagcgtggcgcagggcgcgatccagttcggcgtcaccggcgtcggcgccaagaagcagctcagcggcctgtccgccgagcgcggcgcgctgaagaacaacgcgcccaagctgaacaagctgggcgacgaggcgcgcaacatccagggcgcgctgggccgccagggcagcgtcaagctgggcgcggacgccgacagcatgaaagacatcaagctggcgtcgccgcaggcgggcaaccgccagagcctggccgagatgaatgcccagccgggcgccggcgccggggtggcggacggcatggccgccgcgcgcgacggcgcggtgccgctgcaggcgagcaatcagcgtctggccagccagcatgaagccgcgctgggcagcgtcggcgacgacattccggtgaaaacccgcgccgagcaggccgcgctggaagacacccggctcaagtcgcaggccaagcagaccactggcaaggccatcatggaggcgtccaacgccgccggcggcatcgccggcggttccggccgctacgccgccacgctggagcaagccgatcaacagatcagccaggcgtccggccgggtggcctccaacgcctccgacgaggcgcgcgagcgcagccgcaaggccgacagcatcatccaggatctgctgaagaccctggaaggcgtcagccagtccaagagcgccgcgatgggcgccatcgccggcaacatccgcgcctgatcccgtcaaccgggccggggcgctgcgccctggctgccctgtcgcccgccggcgtcctgctggcgggcgtggagagactcatgctcgactccctgatccgcaccccgtccattccgctgtactccgccgcgcgcgcgcaaagcgaagcgccggccgccgagctgcaaaccgcgccgccgcgcggggaaagcgcgccgcttccgcccaacgccaagctgatgcaggccacgctgcagtccgccaggcagctggacgccgcgctgcagtcgcaacagcgagacgccgccgccggccggccgcccgccggcgaaacgcaggaccgcaaggccttggcgctgcaccagctggacggcaatctgcgcgggctgagcgcggccggctaccgtctggcgccggaagcggtgagcgcgatggccgccgaaaacgacgcggcgcttgacgccgcgccgcagctgctgcgagagcaggcgccgacgctggctgatcaccagatgtatccggacagcgtgttgtgggacaacatcgccaaggccatcggcggcatcaacgacaactatctgggcgtctacgagaatgtggtgggcaagtacaccgccttctaccaggcgttcagcgacatcctggccaagctgggcagcctgatttcgtccaacgacaagggcgacaaggtgacgctggaggtcggccagctggtgacgctgttggagaagctgaaaaccgatttcagcctgcccaattccgccgccatcctgtttcccaaacagggcgccaaggccaccgaggcgcaagccaagcagtgggcgagcgagctgggcctgccggacggctgcgtgaagcccttgccgggcggcggttacggggtggtgctggacctggggccgatcaccgtgatgacaacggagctgaacaagttgggtagcggcaaagtggagctggacaacgccaagttccagtcctggaaggccggtttcgacgcccaggaagaaaagctgaaaaacacgctgcagacgctgacccagaaatacagcaacgccaactcgctgttcgacaacctggtcaaggtgctcagcagcaccatcagcagctgcctggaaaccgccaagtccttcctgcagatctgacgccgaacttccgggagcgcgcatgaccatcacattgcaacgatcgacctcctgcccggacctgtctgcggccgccgcgcgggagccggggccgcaaaccccgctggccggcaggatgcgcggcgccgccgccgcgccggcggtggggctggagggtttcaaggccgacttcgccaaccgcagcctggaggcgctgttcggccagtccagccaaccggagcggctgcgccagttgtaccagtcctccgccaatgcctatgccaagctggaaatcgccgaattcgccaaagtgttccaccggttggcgcaaagtccggatttgagcgaggaagcccgggccgcgctggacgggcaggcgcggcaatacgccgcgcagattctcaaggacggcctgggcgagcgttcggctttcgggccgtggacgccgaaaaccgccaagggctaccagctgcgcgcccggctggagcatcagctggcgcaattcgccgcgctgcggctggggggtgacgccgcccggctgggagccgatttcatgaaccgggaggtgctgcctttcgtgcggcaatacctggagcaccaactggcgggcaagctggacgaagcctgcgtgcgtgaactgaccggcgtgttcgaccgcgccgcgcatcaggctttcgaagccttgcggcaaggccgcgacgagctggtgcagctgcacgggctgggggtgggcaagctggcgcgcgatctggacacggtggcagtgctgccgctgctgatgcgcaatgtgctggcgcagctgcagccgccggccgagggaagggccgatccggccagcccggccgctgatgacggcgcggcgaagccggaggcggccggcggcgtccacatccgcatcggcgacatccatatcgacaatagccggcacatagacaacagccgccatatcgacaacagccggcgcggccgcggcgcgccgacgccgctgtccctggcgctcaagctgcggcgcgatccgggcggcgacggcaaggcgcgggccgagccggctgcatccggcaagccgccgccgccggccgccagcctggcgcgtgatgccgccgtccagacccatccggcagccgctgagcccgcgccgcccaatccggcccaggccgatggccacggtcaggcggcgccattcccggcctggcgcagctattacccggaagcggtgctgcgctccatcggttttcaaagccgggacgacgctcacccggcggcaagggcgttggtggcggacatgcgcagcgcgctaaggctggatgccgccagcgagatggacccgcattcgccgttcgccgcgctggcgcgcgcgcgcgacgcggcattgcgcgaagcgccgggcgaggcgcggcagccatatgaagcgcctgtcgatgctgcgcagtgggcggtgctgaagcaggggcttaaccggcacccgcaaagcgagcagctgcgcggccaggtgcgccggctggcgcgcttgaccaatctcgcgcgcggcgaatggccgcaagacagcgcggtgcagcggttgctgcagtgggggctggcggccatgccggctgccggacccgccccggacctgccgccggggccgcctccggacgccggcccatccatatcgacccaggatggcgcgccgttcgccggcatcgcgctgcgtggcgccgcgccgcgcctgcccgccgccgactacctgcgcggctacccgtttcgcagcgatccgcaagcgccggcgctgctgttgatgagcgcgctgcgcgaagcgctggaggcggacccggccacgccgtggccgctccggcgcgaattcgaccgcagccgcgacgagctgctgccgcgcgcgcagctggaccagcgccgggccttgcaacgcttcgccgacggcgacgccgcggtagcgcccaggctgggccaactgctgtccttgctggacgcccatccgcggcggcaggcgttggtcgatctgggcaggcggctggcgcgcgaaacggcgctgctgccgcgcggcgagccggccaacccgctggtggcgcagttgctggccggactggggctggacgccgcggaagaagcgagacggcgcgagcccgccacgccggcgtccacggtggtcctcaccgtagacggccagcatctggacgccgccgccattcgggagcgcagccgtgccgcgcgcgattgaggccagggtgctggcggtgctgggcgccagcctgggggcggaggtgggccggatccagcccgcgtcgcggctggtggacgatttgtgcgccgattcgctggagctgctcgacatggtgatgatgctgaacgacgagttcggcatcgagatcggcgtcgaggacatcgtcggcatccgcaccgtcgccgatgtcgaggccgcggtggcgcgccgcctagcctagcgcctgccgcagccgggctagctgttcgcgcagcgcggcgtcgtccttttgcggctgccgcagcaaggcttccatctgccgcgcggcatcggccagctcggcgtggccggtggacagcgccgcgccgcccagccgatgcgcgtggtggatggcgaccggccagtcgcgcgcctgcagcgcctgttccagcagctgggcgtcttccccgcaactgctgcggaatatccgttgcaggtcggcgtcggacgaggccgtagcatcggcttgttcctctggcgaggcggcgggagtttccagccacagcgccaggatctgccgcagctgctccagccgcagcggcttggacaggcagctgtccatgccgctttccaggcagcgttgctggtgcgcgatgccggtggtggcggaaatggcgacgatgggcagatggggcggcggctgcagcgccggatgggcgcgcagccgctgagccagctcgtagccgctgatgccgggcaggtcgcaatcgagcagcaccatggcgaaacgctggcctcgcgccagcagcgccagcgcggcgggcgcgtcctccgccatttcggcgcggtagcccagctcccgcagttgctgggcgatgacgaagcggttggccggctggtcttccactaccaggaccgcggcgcttggcgacgccggctgcgaaggcggggcggcgtcgatgtccgccggcttggcggcgggctgcggcaggcagtccaccggcaggcgcagggtcatagtggtgcctagccccggcaagctggacagcgtgatgctgccggccatcaactccaccaattggcggcagatcgccagccccaggccggagccgccgtagcggcgcgtggtgtcgtcggcctgggaaaaggcggaaaacagccggtattgctgttccggctcgatgccgatgcccgtgtcctgcactgtcaccagcaacgcgccgctttctccttccgccagccgcagatccactcgcagcagcacctcgccctggtgggtgaacttcaccgcgttgctcagcagattgctcaggatctggcgcatgcgcaccgggtccagcagcagcgggcgctccagtccgctcaactgcaccgtcagtttcaagccctttttttccgcgcaggggcggtagacggcggccacgctgccggccagcgccgccatgtcggtggccaccggctccagcgccagcttgcgcgcgtccagcttggagatgtccagcacattgtccagcagctccagcaggttcaccgccgaggcgttggccagcgccgccagctcttgttcgcgcggcggcagcgcggcgcgccgcagcagctccaccgatgccaggatggcgttcatcggcgtgcggatttcatggctcatcaccgccagaaacagcgatttttccgcctcgctgcgctgggcggcgcgctgggcggcgcgggcccgctgggccagcagcgccagcgccagcaagccggcggccagcgcgctgagctcgaaagcgtagtagcgggcgatggagccccacgacggcatgccgtagtcggtggtgcgcagccaggtgtataggatggcgtcggtgtcctcggcggtgagctggcccagcgatttatcgatgatgtcgcgcagcatgggctggcgcaggttgaccgccatcgataccagccgcggcatttcgctgacgctgccggcgatgtgcagcgtgccgtaataacggcgctggatcaccgcctgcaaggtggcgtccaggcccacggcggcgtaggcgcggtcttccgccaccgcgtccaacgcggccagcggcgtggccgtcggcacgatgcggatgtcggggtagtactggcgcaggaagtattcgtaggggtcgccttgctccaccgcgacggtcttgccgctgagtttggccgggtcgaacacgatgggcttgtccggccgggtgaccagcagggtgctgccggagaaataggggtcggtgaacagcatctgctgattgaacggcgcgggaatcagcttgggcgaggtggcggtgagcaggtccagcttgccctgcagcatcatggtcatcgcctggaagcggttttgcaccggcaccagttggaagcggatgccgctgatgtcgcctattcgttgcaggtactcctgggtcaggcccttgtgctcgccttgctccagatattcgatgggccagccgtgcgggtctatcgcgtagcgcaccaccgggtggcgcgccagccaggcgcgctcggccggattgaacgggctggccaggctttggccgtggtccagcagcagggcggcggccagccacgccgccagccgggcggtggatttcatttttcctccagacgctgctgcagctggaacagctcgttgtcgcgccgcaggcccagctttttcaacgccgactgcttctggttgctgatggttttgacgctgcgcgagaacttggcggcgatatcgctcaccgacagtccgtgcaggcagcagcgcagcacttcgcgctcgcgcggcgacaggtcggggtggtccagcagggtggggcttgctccttgcggcgcgtccgatgcctccagccgggcatgcaattcgcgcgacatctccgggctgaggtagtcgcgcccgtccgccagcgcgcggatcgccgccaccagttcgtccagcccctgctccttgccgatgaaaccatgggcgccgccgcgcagggccagcgccaccgtggcgggcgtgtagtaggcggacatcaccagcagccgcagccgcggaaagcgtatccgcagcgcgcggatcaggttgaggccgtcgatgtcgtcggggcgcagcgcgtagtcgatcaccaccacgtcggtttccgctgccagcccgccggccagcgcctgcatcagctggctgctggcggtgaagctgccggccacgcgcaggccggccacgccggccaggtggccgctcaggccgtgcaggatcatcaggtggtcgtccagcaaggcgacgcgaatcgggtggggcagggcgatggagattttgctgtcggacatggcgtttcccacggatgctcgccgcagggccgggcgcggccccgccgctctttattgttgattatgcatgccgccggagaaagggcggcatggctgtttttgtcacggcgagcgcgcgtaagcgcattccccctgcaatgattctacccggcgggggagcggagctacaggcttatgtcgatgccgacaatgatttatgcttttgattttatttttgtttcttttgaatgccaaaggccttttgcctgaccggccaggcgtagctattcttcgcaaagcgcctgcaaagacgacagctctccttgcctgaccaattggcgcagccgctcgatgaaatcctggcagcgcaggttgtcctgggcaatgtgttcggcccaatccagcagatccgtcatggcgccaaggctaatcagccggcgggcttcttccagctggctggcatccggccgctgggcatggctagcgtcgggcggcgtctcggcgaaaggtgggccgcctagttgcaacaagctggccaaagtattgcgcagttccgccaggttgatcggtttgagcaggctggcgtcgtagctctgcggccctatcggttgcggcagcgcggaaatggccaccaccggcacgccgggcagccgttggcgcgcttcggccagtaccgccagtccgttggcgccgggcatcatgtgatcggtcagtatcaaatcgggcgaggagctcagtcgctgcattttccggatcagttccaagccattttccgaagcgtccacggcaaaaccctggcccgtcagctcatcggccagcaagcgtcggatgtcgggcgtatcttccgccagccagaccgttttgccttttccgtctatctgcggcagcacgcccagcgcatccggcctgcaatagctgtccatgtccgcctcggacaaggagggcgccgtcagcgtgatcttgaccgcggtgccggcccccggcgcgctgtcgatctgcagagcgccgcccatgcgctccacccattgcttgacgatggacaggccaaggccgatgccgggctgggagcgcgcctggctcagccgcaggaacggttcgaaaatgcgccgctggtcctcaacggcaatgccgcagcccgagtccttcaccgtaagcgacagcttgccaggctgcccggcaagatgccgacggtaatcgacggcgagaatgataaggcccgactgggtaaacttattggcattgtccagaagattgcccaatagctggcgcacgcgcttgccatccagctccaacaccgggggcaactccgcgcccgcctccagcaggaaacggttgccctttttcatcgagaggctctcgtgttcctgcgcaatcgcttgaagcagcgcatggatgtaaaccggctctttcttcaccgcgttaggcgaggcaccggccgcgtagtcgatcagatcattgatcatttgcagcatatgggtggcgctgcggcggatgatgccgccgcgctcggcatcgctgtggccgccggcctgaatcaggtcggcaaagccgatgatggacgtgagcggcgtgcgcagatcatggctgacgcgggccagaaagtccgatttggcgcggttggcttcgccggcggcgatcaaggcgccctgcaactcccgcgtgcgctcgtccactgcgtcctgcagacgctcctgctcttttaaacgagcatccagcaaggcatcctgagcttgctgcttttccagccgcaactgccgttggcggcgaatgttgacggccagcagcagcaggatgatggacagattgccccagatgatttccgccccgccaatcatggattcggacagcaggccaaaccccacggccattttcagaatggcgcggctgctgtacaggcagaaggccaggaaaaacagcctggcctcgcgcgaaccttgccgccatcggtgcaggcaactgccaaagatcaaaatcaggcagggcaccaacaaccagttcaaggcataaatgaacatgctgtagtcgccaaaggcagtgcccgcggcgcagaccgccagcccggacatggatgctcggtatagccagcgccagagcgcgatgccgccggcttcgatgaagcgcatcatcaaggcaagcacaaacgccacgaccaggcagggcagcacgccagtcatgcgtaaaaccgcatcgccgccgccttgcatcaggtagtaatagtgatatccctggaaggaaagatcggccattaagacgcaaaacgccatgcccgccagcagcagcgaaatccggtcccgacgcgccagacccatggccagcgtgtacagggcaatggtgagcatggagccgaccagcagcatttccatggccagctgtcggtcctggttggcgcgataggccgtttgcgtccatagctcaggcgaaatgctgatgatggaacgactgcggatgcgcaggacaaagcggatgctttcacccggcgccaaggtgatgggaaacaccgacagcagcgcgggaacggggtgctgggccagcggaatgcgggtgcccgccaggatggcctgctccacctgaacatgatgcggcggcagccgataaaaacggatgtcctccagccgggacgagccgacggaaagccagcgcgtcaccggctggctgccgctattgtcaagctgcccttgcagccaataagtgtcggaagagaagccggctgtcagccgtttgagcgtggcggcctgccagttggggctcgcgagcgcctgggtaagcgtcaagcgcttgcccggctcccgcatgatgtccagtttttcatttggctggacatgctcgggcgcgccggccaaatcgacagggacggccgccccggcccagccgcagcaggccagcagcagccagagcaagcaggcgcgccagatcatgcgcccgcatctccggcatggcgcaggctggtaggcgggcagccgaacctgtctttgaacgcggtggaaaaattggccgggttgccatagccggtggcctgcgcgatcgactgcaccggcaggtcggtttccaccagcaagcgccgcgcctccttcatccgggcctcgcgcaggaaatcgaacaccgtcatgcccgcgcagctgcgaaaggcctggttcagccgccgggtgttggtgcccaccgcctgcgccaagccggccagctccggcgtgacatccagcgccgccagcagcaacttgcgagcggagcggtacagcaccccgtccagtccgcccgccttgggttctttgcttttatctgccggcgcggccggcggctgcgagcaaggcggggtcatccgcagatggatgcacaagcgcatccggacttcctcgaaatcaaaaggcttggtgacgtagtccaccgcgccggcggccaagccttccacccgttccttgggcagtgcggacgcggtgagaaacagcagcggaatggtggaggtttgctgattggctttcagcaaccggcaggcggtcagcccgtcgcatcgcggcatggagatatccatcaggatcacatccggctgcactgcctgcgctttgtgatagccatcccggccatcctcgccgatgtaaaggcggcaaccgtgccttgacaaaaaatccatcagcagcatgcggtcctgcgcattgtcgtcgacgatcaggacgcgcaggccacgaaggcctgcgtcgggaggtgcagaagcgatctgattcatacttattactatgacatagctaggctgtgtgcgcctaatttaaaatgacaaatgaattgtcttttgttggcgcaaggagaaattaatatccttgcggcaaatctttccagcccttgtgcaaaagcggcgtcttctggcttggctatgactggcatagcatgtgattgcattgaaatgttaagcgccatgctttggcgtctggcgaaaataaaactgcgaaagccagcattgccaaattcaagtcatggcaagttgcatatcgcagtggactggcggcaagcgcatccatgcctgaatggatggtagggctgcttggatgtataggcgcaccgaaaatgcagaagggtgtgcctgcaaggcatgaggtgattttctcggcagatgggatcgaagtagatccgcgcctgattgtatggattgagttccacggtttgagtatttctcacttactctctttgcagcttgctgggtaggccggctgcgatcgtattctacgcattcatggagacatccaatgaagattttctccttgcgcaccaaggcgtggctgggcttggcgattggcggcgccgcgttgttgagcggtgtgatcggggccgagcaggcgtattcgcccgaaaatagcgcggtggcggtggcaggcaaggccgcaaattcctgtttgcctcaagagggatggtttccccatcggcagacgctggagccaaactccggacagttcgctgccgacgccagcaattgcgccttccatcaatggtcatggcaaatgtttctgtggctgacgcaggcgctgccagacccagatcatcaggggcagactctgccgcgtttccttacctttccggacccccgtatcctgcgaggcaagtcccagtcatcggccgacagcttcctgccggcgctgaacttgaaggatgacaggccgctagacgaatacctgcaagcggggccggatggcatgctggtcgaccagaatggccggcttgtttactactcgatgtatctgaatgatgttttcgccaacttcgtcaaagagcagggcctgaacagcgcggaacgcatccgcgatttcaatccgggcattaactatccggtaggaacattgaccttgaaggcggcttggaaggtgctgtcaagcgaggaacagaaacgcaatgacgtatcccacaagttttatacgcgaacggcggaggtatatccgcttaagaagcgcgggaagggattcgaattagaccgaacttaccctcaagaggttgtattggccttggttggcttacatgttgtcggcaccacgcggcatcacgaagaaatgatctgggcttccttcgagcatgtcgacaacgcgccggatgtcgatgccggagcgatacaagaccccaaaacgccggtttcggaccgggactggagtttttacgccaagaacacgccgctttccgcttgcaatcagaacctggcgtccagcggcaagttggagctggatgagacccgccagacattcactcccgtcacgcaggtgtgccggatgtatccgtacggcagcggtccggacaagcagccagccaacgccgccaatatcaaggcgctgaataccgcggtgcgcaataagctcgaggggccgtggaacaattatttcgaagtcggggccatctggttcgatacccagaagggtaagccgctgcaagcaaattgcaacttccagcccggcgccaaccagtgcggggtggtgctggccggatccacgaggttgtccaacgctgccatcgaaacgttcacccagtcgcagagcagcatggacaactgttttgcctgccatcagaccatgccgcattacggcggaccggggcaacaaaccctgcctgggaagaaccttagcatcagccacatcatgaacaatctgtatttcgacctgcaatcgtcgaagaagtcgaactaaggaggatgacttgatgagcgattacattctgcgggtgcacccggccattaatatcgcgcgcgtggggagcagcgatgagttctacattgcgccagaaacacctgctggcgaaagcctgccggatagcgatctattgggtggtttgcctatcaaggccggcacggaaaatacgccgatcgacgaaagcgattttcgcgacgcgcaagggttggtcaagcggcaggcggcgcgttttcgcatcttcgcctatctaaagggcgagcatctgaatcagtatccgatgggtccgcaggctcagccggtggaagtggtgctgggtgcccggctaggcgccaaaatagtgaaggacatcatttggaccgtgcatgtggcgaacaagaagctcaacaacttcgccatcgggagcgatgggctggatggctatgacgatccagccagcgtgccgctgcgcaatggctattatcccaatctgccgcccaacttcccattgctgccgacgacgaatggctcgccgtattggcgcgaaattctgagcaacgccaagcgttgcatggatttggtgatcgatcctggcccgcgcagcatcagcgcctttcatgatcaaggcaaaaccaaggccttttcgaagcgtgaacgcgcctgttttgccgatggcaagggcaatatccagtttttggattacccgcaacattttcccgatgatgcccacccgtatctggagcagcccttggggccgatcgcctccctgggggagttgcgagtcgatgcccaagggcgcttgctcgtcaccgggggttttggccatacggcgggggtaaagctatcggcaacggggctgccaccaagcctggccaactcaaccgagaatggactgtggtttgacgatacgtcagatggcccggtcaatgcggtggtggtgttcgatgatggaagctgcgaggcccatggtgcctgggtggtgactggcgatcccggctatgcgccgcaaatccgcaatgtcgtgtccgcctgggacgatattttcgacatgtgggtgcgtgaactcgatttgatgccgagcctctaccgtggtaacgcattcaaccatggcgagtatcagccctgtttccgccatcaggtgcagcctattttccgggcggccatgttgcagcgttggggcaccaatttaccgaaccatgttgtgaatgcccatgatggggtgggcgccattcagcccacgacggatcccggcgcgatcattcaggacttggaaaaactgatccgcaatccggaaggctcgccccaggaaatgcaaacgggccggccgctgatgcccttgtctttgggcgacgctcgcaagagcttcctgacagtgacccgcagccaatatttctttttgcagtgttggcacaaacagcagttttcggccgaagacgcgatgcccttgagcgtgggagagaaactggactatgccgcgctggccaactgtttgggcggccgttacagcccgggcatcgaggtgtctttcccggtgcgggaccgcaatctgtacatccagaattggcgcgagcgcgactgcggccccttccgtatcaatcaggctcggatcgattacgccaacatcgacagcggcgagcctgtgctgcgttgcggctatgtgccgcggcaaatcggagcggtggagccgggcgatctttccaagttcatgtcggtgccttggcataccgattacaactcctgcgcagtccacctgcccaagccgaatcccatcaatgtagatggcaacggcactccataccctaacaatgtgctgttctggtcgtggccggcgcagcgcccggtgcaggtgtttcccaagtccagttgcgattacgacccggcaacgggaacctggaaattgggcaatcaggtgttttccatccgcggagtcggaaccgagacggaatacccggccagagcgggcagcttccgagagcatgcagattatatgcggcaatggaacaagaccggctttgtgatccaaggcttgcagattccatccgcgcagggaggcagctatggcggcaagctgttcctggaggtgtccagccagtggggcccggaggagggaccgccagtgcagccgtttcctacggcttccgtgccgcctgagcctgaggggaaggtttgacgacgcggagcctggcgctgcaaacatgcgatgtggcggaagcggaagccgtccgtgtcgcggtcatcggcgcaggcgtggcaggctgcgccgcttccctcagcttgctggcttgcggcgtggatggggtgctgatgctggacagcgactcaggcgggagggcggatcgggtaggagagtgcctgccgccttcgtgcgcgccgattttgcaaagcctgggtgtgtggaatgactttctggcccaggggcacttgcccagtgtgggcagcgctgcgtgctgggggcgagacggctggggcttcaatgatttcctgattgatccgcaccgttgcggctggcatttggatcgccagtctttcgacgcgagcatgttggcggcggcacaacagcgcggtgcccgcttatggaaggggtgccgcttgcgcggcttggcgcggcgcgacaccggtggctggctgctggatttggagagggaaggccaggcgctcctgcaacgggcggactttgtgctggatgccagcggggccgccgccgtcgtggcgagacgccttggcgtgatgcgcaacgaaatagactgcctgaacgtgtcatatgcctatttgcactgtgatgatgccatggcctttcccgcgcgctcctggctggaggcggtggaaaatggctggtggtacgcggctggcgtgccgggcggcaggatagtcgcggcttatgcgacggaccgcaaaaatcccgcaaagccgcaaggcccggtggcgtggatggcggcattgcaaagcacccgccatctatggccggtcatgctgcgcgcgcgtcccgcctccatgccgggcgcggtgcgggtggcggccgcgcccagcgccattctgagcaatgtggcgggccgggactggttggccgtgggcgatgcggcgtgcagctatgacccattgacggcgcatggcattttgaaagccttgcaagacggagaggctgcggggcgggcggtggcgaatgatttgggtggaaatccccaggccatgcacgattaccagaatggcattttcacccgcttttccgactacttgcgcttgcgaaaccgtttgtacagcgaagaggcgcgctggcggcatatggatttctgggcgcggcccttgacgcaagcggcgcggggcgctggcggcggaccgggcgcggctgtggattgacaccaatggcgcctctgatcggatggagcgcctattgatggtcgacgagtttgcgctgcgccgttgggcgcagcttttcagcggaggaaaatatgcagcacatcgcaagcaaacgggttatcactcgactggccgccgccgctcaaggcgtgctcatgttgggatgggccgtgctggcggcagcggaaccgctgcctgatcccacggcaatcgcggatccgccaccgctgcacccccgcgatctatccgagcctaagcctaaaaaggggacgctgcagctgcagaacttcatgtccctcccagctttgtcgaaatcggagtctggcgtatttgacaagccggaattcctgactcctgatactgtggatctggatttggaagttgcgatgctgagtggaaagatacgcaatccatcggcagacaaagagggagaggcgcattttgaccgcgtcctgctgcgcggctaccgcccctggtgcgatcctggagagaatggaaagccatgccgggcatcacgggtcaccaagtcattcatcgcgcctttgatccaggcccatccgggtcaaacggttcgaatcacgctgcacaatgatctgccgcctgatccgagttgcgtttctcaaggggggagcgcgaataagccgcactgcttcaatggcaccaatttgcacactcacggcttatggatcaatccggccggcaatagcgacaatgtgctgctcgccattcaccccggggtggcttttcagtacgagtacaacatcccgttggagcatccggctggaacctactggtatcacacgcatctgcatggatcaacggcgctgcaagtgtccagcggcatggcaggtgctttaatcattcgcggcaacaggcagcctcaactggatggaaatcaggccaattccagtcagaagaattcacatgtccatggagatctagacacgttgttggtgtcaagagataaagatcagttccaggagcatacctttgtctttcagcaaatccaatatgcttgccgtggaaaagatagaaaaataaaaaccaaaaacgatgaggaaggcgggccttatcgttgtgatgatggcgatattgggcaggttgatggttacgatctgttcggtcctggtcggtgggaaaagtctggccgttataccagtataaacggagtggtgatgggcaaactccagaatgcgaaggtaggtaaggtgcagcgctggagaatgatacatggcggtgtgagagataccattgctttggaaattcggcgccgcgaacccatttccaatgaaagcgcgcagagtatttctggacttacggcggaacagactcaggactatgtcaataaagagtgcaccggcgagcccatccccttcactttggtggccgcggatggtttgactatggcgcaagccatgcagaagaagcggctagttttccagcctgggtaccgctgggacgctttgatggtttttccgcaagctggtgattattgcctaattaacaaagtaggccgctccaatattgacctggttcagccttacacaagactgctgggcatgatccatgtcaatgcagcaaatatgccagttgtgcccgatgacatcgatggcagcatcaagcgccatctgcaaaatctgttgatcaaagctgcgcaagataactaccgctccgccgtagcaaagttggtggtggcggatctgcggaatgatatgaagctaacccgctttgtgccgcatgcggatatccaggactcggaattgactggccagcagcgactggcatttaacatagacacccagtctgtgaaaggccagtcattctatcagattgatggcaagccctacgatggcggaagaatagaccgtactctcccattgggtggcgtggacgaatggacgctgacgtcggactttgccagccatccctttcacattcatgtcaatccattccaaatagtcaaaattatcaatccgaaaggtcaagatattagcgggccaatgccacaagctgatgacgacgacgatcagtatcatggcatgaaagggatgtggaaagacacgctgtggatcaagagcctgtttgacggcacttccgggggtgaaaaggatgcggcggcgggaagatacacctttatagtgcgcacccgttaccagcgttatgtcggagattttgtgctgcattgccacattttggaccatgaggatcagggcatgatgcagaatgtgcgcatcgttttgccggatgcccaaggaaatctgacagcaggccatcattagcaatggactgagagccgtctcaattaattttctaagtgattatcctgaagcatcagcaagcaacttaaggaaaatatatgagcaatttatatctggacactgccattgtcggtggtggcgcttctggcgcgtatagcgcttggcgtttgcagcaagcttatggcgaggagcgtaaaatcgccttgtttgaatacagcaaccgcattggcggacgactatatacggtgactatgccaggcctgcccaatgtcaaggcagaagtgggcggcatgcgttatattccggatcagcactatatggttgccaatctcatcggccaccttggtcttgccaccaagccctttccgatgggggagcctgcgccggtcgggtccagctgcaatatattttatttgcgcggcaagcacttccgtctgcacgaattgtccgatccggagaaggtcccttacaacctttcctggtcggagcgcggccttgggccgacgaatctgcaagtgcaagtgatgaattatatttaccccaatatgcagaatctgtcactgtgtcagcagatgcaggttaaggcgtatggcaagcacctctggcagtacggtttctgggatctgatgttccgcgctctgtccaatgaaggctatcaattcatgaaggatgcgggcggatatgatgccaatgtggcgaatgccaatgcggtgactcaattgccggcgacggaatatagcgacagcacgatatttctgaccttgaaggatggctacgatcagctgccgattcgcttggcgcaggcattcaatcatgaactcccgggcctggctcccaagggagagcggatttacatgaatcattgcctcaccgagattcatgaaaacactggcgaatatcgctacaagctggttttccgtccgaccaaggtgcagcagcatgagggcgggctgcgttctttgcttgatcatggcgccgaccccatcgttgtctatgccaagcacatcgtgcttgcgatgccgcgccgctcgcttgaactgatcaagtctgatttcttttttagcgatccttggctgaaagaaaatctgaagtcggtgctgatccaaccggcgttcaagctattcctggcctacgagcgcccctggtggcgttcgctcggcctggtggctggccgctcggtcacggacctgcccatccgccaagtctattacttcggcacggaaagcgagcaggacggcgggcagccttggctgaactccttgctgatggcgtcatacaacgacatcagcacggtgccgttttggaaggggctggaagcggggcctgcgttcaacggttatcgtccggactgcatcgaagcagacagcagcaatgttgttccgcagatggaacatgtggctaccgaggaaatggtatttgtcgcgaacaagcaagtggcggaagtgcatgcccagcagcagattccgagcccgtattccgccgtgtaccatgactggagcgacgacccctatggcggcggttggcatgagtggaaggcgaattaccggctggaccagatcatgtggcaaatgctcaagccggttgatgcgcacaatattttcatcgtcggcgaggcgtattccataggccaaggttgggttgaaggggcgctgtgcaccgcagagcagatgctggaaaagcatttccagctgaagcggccaggctggctgaaagaaggctatgagctgatgcctgtgccggagggtggctgcggcgagttgtgcggctgcatcccggccagcgccatggggtcgacgcttgaggctatcacgccgaactgtctcaagtgcgcgcaggagggctaagcgatgacggcatcgactcccgcctacacggtttcaaactacatactggatcgcttgcggcagcttggcgtccagcatctgttcgaagttcccggcgactacgcatcgattttcttgaacacgctcgatgaatgtcccgccatcgagcgcatccccaacatcaatgaatcgggcgtcggttatgcaagcgatggctacgggcgtttcaagggcgcggcggcgtgcagcgttcaatatggcgtcggcaccttctcgatactgaattgttttgccggcggttttgtcgagcgcgtccccatggcgctcatcggccctagccccagcacgcaaaatcgcgagcttgcccgtactgaggggatactgttccaccacagtaccggcaatctgaacgccgatatgcgggttatggaaaatgtgaccgctgcggccgtcgccatccatgatggcgcgagcgcgccagcgttgatcgacgaggcgctgacggcgatgctcactcaccgtcgtccagtgtatatcgaggtgtggcaggatatcttcggcgtggaatgcgcgcggcccagaggcgagttgcgagcggtcgagaccgcaagcgagcctgctgcgttgcaagccatgctggatctggcgtggcaaaccataagcgatgccgcgcttccggtgttttggctgggcgttgaaatccaacgctatggcctgcaagagctggcgcagcagctggtcgatgcgagcggtctgtttttcacgaccaccagtcttggcaaaaccgtgctagacgaaagccaggcttcctttatcggcacctatgccgggccagcctcccccgcgttgacccgcgaggtgatgggcagcgccgactgcgtggtggcgctaggcgccatcatcaccgacgattacctcggcatcatggcgcaggactatgccaggatggtggagatcaacgatgaagccgcgcgcatcggctgcggccattatcaaggcgtgtatctgcgcgatttcatgcaaggcttactggcgcgatttcagcggcgggcgagcgcgcggcgctatcgcctgccgcaagtcagccccgatccgcagcccagcttgctgccgactgacgggctcacctatgaccgcttttatcatgtgctcggggattggctgattcaggagggccatatccggcaggccaagctgattctgggcgagagcaccagcttgtatgttttcggcaatctgtttggcatgccgcgggatgcctttgtcgcgcaggccgcgtggggctcgcttggccatgagacgggctgcgcgctgggcgtcgaactcgccaccggccagcgccccttggtggttgccggcgatggcggcttcatgatgatttgccaggaaatctccagcctggttcgccagcgctccaatgccgtcgtgtttgtcatgtcgaatgccggctacgccatcgagcaagctttcgtgaatctcaatgccttcacgccgcaagacaactacgcggcttttgatttgctgccgaattgggattacctcgcattggcaaaggcattcggcgcgcgcgggcatgttgttgaaactgtcgatcagctgcgcaagctgctcaagcagttggagcatatggacggggtgcccaatatcgtgcaagtgaagataccgttgaaggatctgccgccgcagctgcggcgtttggcaagcggttgaagtgctagttaggcataggtttgttctggcttgtgtgggcgttgaggggggcgaggagcttgcctgcgagcgcaagcgggacgatatatcgcaaaaaacagcgcggcgccttgccggggagtccggggggagagccgcttggcgcgcggggcggcctggcagccgggcgcgtgggcgtccgccgcagattgttcgtgcgggctggggcaatggtcgcgcgattcggccccggcttgtcggccctgggtgacgataggaggggcttgccggggcgtcggcgccaagttgacggggcgcaatggcgcgcgtgtcgcagtcagcgttcgacgctgtggcaatgcggcattccggtcccgcgcggcggtaaaacgcttcgtccgactgcgttctattccttcttgctggcggccggaggaatcgtaaaccatccaggcggactgggtggccggcatcgcccgcattcctggttttgcggcggggagcgggggcagtccagggcttgtgttgatgcggtggggtaggggggtggagcgaggtgcggatttttggcatgcgccgaaagcttgcggggggcggtcggtgtattggtttgcttggtggtaatcatggaaaaacttccgataagtaaaattatcggaaaaatatagaataaatagtaaattaataatgtaatacgtaatatatttatcaatagatttttgctacactccacgccaagttgcccaagggcagggagagaacaatggctgcagatatttacgcgaggatccgccaggcggcgtttgagctggtgggcgagggggtgtggcccaccgtggtggatgtgcggacccgcctgggaagcggctccaacaccaccatcaacaacacgctgaaggaatggcggcaggaatttttaggccgggtggccgcctcgtcgcggcggccggattggccgcccagcctggcggaagcttttgaacaggtgtggcagaaggcttgcgacgaagcggagcagcaattgagcgcggtccggcaggaggtggaggcggaggcagccgagctgcgcgcggcgctggatgccagccgggagcaggcgcaaaaaaccgaggccgagctgcaatcgttgcgccatgagctggaattgcgcgccgcgcggcaagtcgagctggacagccagttgcagcgggagcggctggaggtggagtcgctgcggcgtgagcggcaggaattgcggcagaccgccgagtcgcaacgccaggccctgaccgtggcgcacagggaggcggaatcccggctgctggaaatggcggaccgccacgagcagcagctgcgcgaggtgcaggaggaggcgaaccgcaaggaggcgttggcctatgaacgcctggaaggcttgcgcgttcgtctgtatcagcaggtggaagacgagcgccaggaaatgaaggggcagcagcaaaagctggagggcgcgctgctgcaggcgcggcaggacgcagccaaggtggaaaacctgtggcgcgagcgggtgctggagcgggaaagggaaaacggcggcctgcaggcccggctcgatctgcagcaacagcagggcgattcgctgcggcaggaggcgcgccagcaggagcaggcggcggaggccgcgcgggagaggctgctgggcgtgacggccgaactggccgggctgcaggcgctgcacgcgatgcggcgcgagcaatggctggagcggcttggcgcggcgctgcgcgccggcgccttgccggcggagccggaggcggtgcagccctggctggccgcgctgttggccgagcctgtccggtagccgcgcgacctgtcctgtgggacatgccggtttttccgcggccggcgcggccttggctatgctgaatgggtttcatcccatccaagaaaggagccgctatgactgtgcaaggatatgccgttctctacctggcgttcatcatcgtgctgtttgccgctttggtttggaaaacccccgttctgcgcgaccgcgggccgttggcgccgggcgtggccgatggccagcaaaccttcagcctggcgcgcagccaactgctgtggtggacgctgtcggtggcgctggtggcgggctggctgctgatcgtcaccggcaatctgctgtcgcccacgccgcaggtgctggcgctgctcggcatcagcgccggcacttcggggctggccagcctggtgggtcagcctgatggcggcgcgcaggccgccgcgctcggcggctcccgcggctgggtgcgggatgtgctggaggacggccagggcatttcggtccaccgttaccaggccttgctggccaatgccggcatcggcctggtgttcatctacaaatcgctggagctgaaggctttctacgcgattgatccgatgtggctgggcgtgttgggcgtcagcagcgtgctgtatgtcggcatgaagtcgcgcgaaaccgcggccgtcggcgcggaggcgctgtcggcgccggcgctcatccagccgcaggcggtcaagccgggcaacacgccgccggcgctgcaggtctgacgccgcgccgcttttcgcaggcagaggccgccgcggcggcctctggtcattttgacgcggaccatggccagtcccgccccgatcccctacaataacggtcaattcaatcaaggcggcctctgcgtgcaacgcgaccggagtccgctttttcattacggaaagacaaatggaacctgtacgcctgtcaaaacgcatggccgagctggggctgtgttcgcgccgggaggctgacagctatatcgagcaaggctgggtcaaggtggatggcgaagtggcggtgttggggcagaaagtgctgccgcacaaccagatcgaggtcgacaagaaggcgcaggatgcccagtcggctcgcgtcaccatcttgctgaacaagccgatgggctatgtttccgggcaggcggaagacggctacgagccagcggtggtgctgatcaccccggaaaaccactgggccgaggacggcagccgcaagcgcttccaggcctcgcacctgcgcgggctggcgccggccggccggctggacatcgattcggttggcctgctggtgctgacccaggatggccgcgtggccaagcatctgatcggcgagaactcgtcggtggagaaggaatacctggtgcgggtggaaggccagctgaacgccaacggcctggccctgctcaatcatggactggagctggacggcaagaagctgctgccggccaaggtgagctggcagaacgaagatcagttgcgcttcgtgctgcgcgaaggcaagaagcggcagatccgccgcatgtgcgagatggtgggcctacgtgtggtggggctgaagcgcatctccatcggcaaggtcaagctgggcaacctgcccaccggccaatggcgctatctgcgcgacgacgaacagttctgattcgacgggaggggcggcatgttcgaacggctgcggcgcatcctggggctggaccccgaagcccggcgcgaggctagggcgctggccggccaggtggaacaattgatagacgcttgcgacaagcgcctgcggctgctgcccggctatttcgacgcgctggcgccgggcatgcgcgtgtcgcaggcctatctgtccacgctgacggcgcaactgccgccggtgctggagctgtccttgcctggctttgcgcgcgatccgcgcctgggcctcttgttcgccggcccctccagcctgcttgcctttctggaaagtagcgaagtgctgcgcgacttctttcttcgcgcgggcaacggcgacgaagcctgggccttgctgaccatgcagcgcagcgaaaccaatcgctttggcgtggcgatggaaaacggcgagctgcgcaacgacgtggcgcaggtggtggtgagtttcgacggccaccggctgatgatgcccagccccagccaggaacgcttccggctggattcgggcgcgcacgcgctggacgtgatggtttcggtgatcgcgcgccggctaagcctgatggaacaggcgcgccagcagctggaggccgaacaggcgcgcttgcaactgcgccggctgtcgctgcaatcgagcaattgcgtggtggtggattgccagtccggtgatgagagcctgccggaaacggcggccgccgtcgatgcccggctggcggaaatcaacccgcagctggacgagttgcgcggccatgccagcctggaaggcctgctacgcacggtgcgcgaagtactggagcagccagcggattacttcagcctgcagacggtgacgttgcggctgagccggatgggcgtcaaggtggatggggatgcggaggacgccaccgagctggcgctggaggaagtggtgttgggcagaatgctgccgatccgccgggctttggtgccggtgcgcatccgccgcgacgacatcgccgaattgcgccgccagtttggcggcgattgagcgaaaagccggtgcaggcgcggcgggagcggctatgctgaatacagtgagagtttcaatcggcctcagggcggtcggttgaatctgccccgacctcctggccggggcttttttatgcgcgtcagccgcgcggcttgccgtcctggccaaacaaaatggcgcgcgaggcctcggtgagcgtgggggtggtgttgacgctttccgccagcttgtaggccctctgcaccgccggccgcgccgcgatgcggtcgaaccagcgtttcagcgccggaaaatcgttcagatcctggcgctgtttttcatgcggcacgatccaggggtagcaagccatgtcggcgatcgagtactcgccggcgatgtagtcgcggccatccgacagccgggtgtccagcacccggtacaggcgggcggtttcgcgcacgtagcggtctatcgcgtacgggagcttctccggcgcgtactgggtgaaatggtggttctgcccggccatcggccccaggccgcccatctgccagaacagccattgcaggacgtcgttgcggccgcgcaaatcttgcgggatgaagcggccggtcttgtcggcgagatacaacaggatggcgccggattcgaacaggctgatggcggcgccgccgtcggccggcgcctggtcgacgatggccgggatgcggttgttgggcgagatgcgcagaaaatcaggctggaattgctcgccctgggagatgttcaccgggagcagccggtagggcagcccggtttcttccaggaatagggtgatcttgtggccgttgggcgtggtccagtaatgcaggtcgatcatggcgggcttcctgtggctttgggtatgaagtcatgacatgagggcatgggagcgttttcaaaggggccgcgcgggatttcgcctgcgcgcctggctgcgagggtccggtctggaaaacgcccggcatgcggtatgatgcgcccatgaaaatcaacggcacacaatcatgagccaaacattggactcgcactcccgcttcatcagcctggtgctgcggcatcagccgcaggccatcgggctggcgctggacgagcagggatgggcgtctttggatgagctggtggccaaggcgcgcgcggcgggccgccaactgagccgggaggtggtgttggacatcgtccggaatagcgacaaacagcgcttcgccatcagcgcggacggcctgcggatcctcgccaatcaagggcattcggtgcgggtggatctggacctgacggcgcaggaggcgccgccgcggttgtttcacggcacggcgcgccgctttctcgcggctatccgcgcagagggcttgcggccggggcagcgccatcacgttcacctgtccaattcggcggaattggcggcctcggtcggcgcgcggcatggcgcgccggtggtgttgacggtggatgccgcggcgatgcagcgcgccgggctggcgttttatcagtcggcaaacggcgtatggctggccgacgcggtgccgccgcagtttctggcattcccggaatgacggcgatgccaggcggggccggccgccggcgcgcgggagagcggcgatgtgcgtgaattttttgccgccgtcccggcgccagatgcgggaatgcttcggcgcggagatcggcgactggcagtggcgggacgaggcctggcaggattacctggcgccgattctcacccgcgacggcgtgaggctggcttcctacggtttcattcccaaacgccatcagccgctgggcgcgcggctgtccaccatgaacgcgcgcgcggaaaccataggcgaattgcgcagctaccgcgatgcctggcgccgttgccagctgtgcctggtgccgatgcaagcctttttcgagccctgctacgagcgcggtcgcgctgagcgttatcgcatcggcctggcggacggcgcgccgttcgccgtggccggcttgtggcgcgaatggcgcgaggccgacggctcgatcagcgccgccttcacgcagatcaccatcaatgcggacgagcacgcgctgatgaaccgcatgcataggccgggcgaggaaaagcgcagcctggtgatcatcgagccgtcgcagtacgacgcctggctgaattgccgcaatccggaggccgcgcgcgcctttttggcggcgtggccggcgcaggacatggccgccgaagcgcccgacttgccgagccaaggctccttgttcgactagccgtccggctgggaatcagggcgccccgtcatttgacccgcaatatctggtccagccgggtggagtagcaaggtgagcgctgatcctggcgcatctcccagtttttcgtcagcgcttcagctcccagccgcaggctgttgcggccgtattcgcggttgatcgcgtccatggtttgcatcagcttttgccggcgcgggtcgggcgcctgctgaaacagatcggtctggcgaatgccgcgcggcgagatttccatcaggatcacgcccgctttctggtaaagcagcccacgccggtagaccgcgcgcaggccggcgagcgcggcgcgcgccagcgttatggtatcgtcgctgggctgcgccagcggcatggcgacatagccgttgtagggggcgcccaggaaggggctggtgcgtatgctcaccgccaccagcccggccacgctgttctgctggcgcagcttttccgcggcatggctgacgtggtggctgatggcggccgccagcacgttcaggtcgcgcggtttttcgccgaaggagcggctggataggatttgctgccgggccggcgccacttcgcccagccgcaggcagttgacgccgttcagctccgccacggtgcgttccagcgtcacgctgaactggcggcggatctgatgcggatcggcctgtttcagctgcagggcggtatggatccccagaacttccagtttgcccgccagccgcgggccgacgccccaaaccttgcccgccggcagcgtggccatcatcgcgtcggcgtccgccgcggacagccagtcccaggaaaacacgccgtcccaacgcggttgtttcttggcgatgtggttggccagcttggccagggttttgctcggccccagcccgacgcaggcggggatgccgatgcggcgcagcacgtcgccgcgcatgcgccgggccagcgcctcggcgtccgccacgccggtgagatcgaggaagcattcgtctatcgagtacacttcctggccgggcgcgtggccggccaggatggccatcatgcgccggctcatgtcgccgtacagcgtgtagttggagctgaacaccgtcacgccgtgatgcttgcaaaggccggcgatttcgaaaaaggggccgaacatccgcaagcccagcgccttcgcctccgcgctggcggccaccacgcaaccgtcgttattgctcagcaccacgatgggtttgccggccaggtcgggccgaaacaccctttcgcagctggcgtagaagttgttgccatccaccagcgcgtactggctcatcggaatttcctcacgcaggcggtcaccaccccccagatttgcagctcctgcccggcggcgggcacgatggcggggtaggccgggttttccgccagcagcatccagcggccgtttttgccatgcaggcgcttgacggtgaattcgccgtccatcgtcgccaccacgatatcgccatggacggggggcaagcccttgtccaccaccaacaggtcgtcttccagaatgcccgcgtcgcgcatcgaatcgccggccacccgcaccatgaaggtggcgggcgggtcggataccagataggcctgcaggtcgatgctggcgtccatgcagtcgctggccggcgatggaaaaccggcgcgcaccggacatagcgccagcggaagcgggcgggcggcggccgacgggcggagagagagggggaaggtgttcatgcgctgcgcaatttgaaaatgtacaaattcaaattacgccattttcttaccgttggcaaatcctgagcctgcgcggtcggctcagcctacccgctgcagccggtaggtgtcgcggccggcgtccttggcgcggtaaaggctctcgtcggcgatttccagcaggcgttccggcgtgatgtccggggtaagggcgaaggcgatgcctatgctggtggacatgcgcagcgtctgccggttgagctcgacatcccggcgcaccgccgccagcagcttttccaccacgctgaccgcggtgcgctcggcgtccaggccgatcagcaggatgacaaactcgtcgccgccgaagcgggcgacgtggtcggtggcgcgcacattgccgcgcagacggcgggcgaattcgcggatcagttcgtcgccggcggcatggcccagggtgtcgttgacctgcttgaagtggtcgatgtccagaaacagcagcgccagcgcctggcgcttcatgtagtggtgcttgatctcgtcgcccagcagctccatgaaggcggagcggttgagcaggccggtcatcgcgtcctgcgtcacctggctgcgcagctggatttcccgcgcccgcgcctgggtgatgtcccagatcatcacgtaaaagcccgacaccgagccgtcggcgtgttgctgcgggatgtagcggccttccacatagcggctttcgccgcggacgtccatttcctgctcgaatgaaaccgcttcgccggccagcgccttgccgacatggggcaggaccgccgcgtaggcgtcctcgcccaggaaatcgcgcatgcgcatggaaatgatttgctccggcccgatgccgaacagccgcatataggccttgttgcaatagcggtagcactcttcccggtcgacgaaggccaccagcgcggggatggagtcggtcacggttttgagcagcgcttcgcgcagcaccagatcgagttcggccagcttgcgctgtgtgatgtcgcgcacgctgacgctgacgctatcgccggcgcggacgatttcatggtggatccaggcggggtgcgaggcgtcgaacaccttgggcacctcttcggagatggcgttgccggtttcgatcaccttcttgtagctgtcgaagtaattgggtatccggtaatcggccatcagccgcttgagcctgcggcctatggcttcgtcgcggcgcaggtgccacatccgctccgcctcggcgttgatgtagaccacgtggaaatcctccacttcgccgccggcgccgcgcagcgcctccatgatgatgaaggcgtccatattggcctcggcggcattgcgaaagcgttccgccgccaattcggccatccggttggactgcaatacttcatgcagcagcggatgggtgcgccagcgcaggatcagcgatcccagcgtcaccatcgccagcatgatcagcgcgctggtttccaggtcttgccggatcggctccatcaggtcggccacccggatcttgtagctgaaggccaggccggtgctgccgaccggctcgtaggcgccgatcacgttgcggccggagtagtcgatggtgtgcagggtgccgcgttggccggagaacgccggccagacggtgaagcgcgggatattgccggccagcgggatggtactgcccttgtcctgcggcgactgcgaaaagcagcgcaggtagcggctgtcgcgtccgcacagcgagtaaatgccgctcaggccgcggctgggcgcggtgtcggcgacgatgcggtcgaacatgtccagccgctgctccagcagcagccgcgcgctgccgccggaggtgcggtaggtgtccacggtgcggtacaggtagtggccattccatagcagaagggcgccggcaggggagtttagcgccaccgactggcgcggccggttttcgaaatagccgacctgcaccagcgtgcggccggcgctgtcctgtatcgcgatgccgttcaggttcatgtggttcagcgccgccagcttggcgccggcgccggcgtccacatggccgctgcttgcggcctccagcagcgcctgcatgtccgggcgttggtacaggcggcgggcgatgtcgttgctgatattgaattgggcatccagcaaggcggcgcgttgccgcgcgctgtacagcatcaccgtgcgcaggctttgctcgtgcgcgttgctggaaatgcggtaaaccagcaggccagtggcgagcgaaatggccaccagcagcgcggtggcggtgagagaggccgagttggccaggtcctgcgagcgcaaatggcggcgcggctccaatcgcgtcaacgagtacagccccaggctggcgatcatgacgccggctgcggtgagcagcgccatccgggccaccgtgccccagctgtacagcaactccaggctgatcaagtaggccgcggcgcccagaacccccagcagcagggcgaaggcggcgcaggcgcgcgctgcccgccgccagccggcgtggccgggcagcaggcatagcccggcgcccagcgctagcagcgccagcgcggtggagggcgccatccgccccgggtggggcaccagatcgtgcttccaggcatgcaggcgcggaaaatctatccaccaggtctgcccgctggcgtgctccagcaataccagaacagcgatggccagcgtcagcgcggccagcaggcggtgcgcttgccagcggggccgccacagcgccagccccaggcccaatccatacaaaaccagacagacagcagtggatatcaccatgtggacattgtccggcaaaatggattccgaatgcgccagccagccggcgatcacgctagcgcccagcaaaaccagagccaggctggctacgcagatcagcagccgatgccggcggtgaagcagttggcgccggaattcggcgatcgacaggcttattttgggcaccgcttccattgggtaagccgatagtgaaggtctctaagccgaatgttaggacaaatacgcggcgcgggacggggtgcggtaagtgaaattacatacccaccgtcggatcatgtgcttgtccgatgatttgcggcaaaacattccatgggtataaattgcgaggcaggcggatccgcgtcaagacggcagcctcccaccatggaaagagagaaaccatcatgcaagcatccaggcaaccgcaggctgggctgatcgagcgccggtcgatagatttcattcccgaagacgaacgccacgggcgggttttcagccagttcaccctgtggctggcggccaatctgcagatcaccgcggtgatgaccggcgcgctggcagtagtgctgggcggcgatgtgttctggtccatcgttggcctgctattggggcaggcgctgggcggaacggtgatggcgctgcacggcgcccaggggccgcggctgggcttgccgcagatggtggccagccgcgcccagttcggaatcaagggcgcggtgctgccgctggcgctggcctgcgtgatgtatctgggtttcaacgccaccggcatggtgctgtccggccaggcgctgggtcaattgctgagcatcagcgaccgcgccggcatcgtgttgttcgcgctgacggtgctggctgccgccgcgttgggttatcgcgccatccacaagctgggacgctacgccagcgcgctgggcctgctggcttttctgtacttgtttgtccggctggccgccggtgtcgacctgccggcgctggcattgacgcacaagcacttcgatccggccgccttcctgacggccgtgtcgctgtccgcctcgtggcagatcgctttcgcgccatatgtgtccgactattcccgttatctgccttccgccacctcgccgttctggaccgctttggcgataggcctgggctcagggctgggcgcgcagatcgccatgtcgctgggcgtgctggtggcggcggtgggcggcgcggctttccgcggccatgaagtagcgtattttgtcggcttgggggccagcggcgccatcgcctccggcctgtttttctgcgtggccttcggcaaagtcaccatttctacgctgaacgcttacggtggtttcatgtgttgcagcgccatcgcttcatccttgggcggggcgcaggcgacaatcgggcagcggcggcgctgggcgacggtggccgccatggtgttggcgtcggcgtgcatcgcgatcctagcccagcatggcttcctgtcgctgttcaaatccttcttgctgtttttgctggctttctttacgccatggagcgccatcaacttggtggatttctacctgatcgccggcggcaaggcggacgcggcggcgttggccgacccgcagggcaggtacgccggctgcgactggaccggcatgggcgtgtacctggcgggcatcctgttgcagctgcccttcatcgactgcgccttcttcaccggcccggtcgccaagctgctgggcggagcggacatttcctggctggtaggctggctggccccggcggcgctctactactggctgcgccggccacaacgccggcacgtggtgtccggcgccatgcgctgagccagccgggcaggcgccacggtattcggagcgcccgtcttgcgaatcaccatagaggctgggccgaagggcagggcggcgccactggggcgttgctgccggtatcgaggaaaccgtcgctgatccagtggccggctgcggtgcggttccagatgtcggtgcggccccatacgccgttcaccatctcgccgcggacatggcattgcagcgccacctgctccccgcgggccgccgagcccgcgacgtcggcgctcaggctgggcgcgcggcgcaggttgacgcggctgtcgccgttgccgggcgtggcgatgccgctgacgcctcccggtgctggagtagagtcgccagcgccgtagttgactagccggccgccgacattcacccggttgccattgcgctgcgcgtagccttggtaggcgcggttgccggcgaaaaactgccagccgccgatctgcttgcggtgcaccggctcggcctgtccctgatggatcagggaaaagtgcacatgggggccggtggtgctgccgccgcaaggcaagccgttgcctatcgtgccgagatacgcgcccttggccacccgctggccatccggcgcggcgctgagcttgaccatgtggtagtaggtggtcgagtagccgttgtcgtgcaccagcttgaccagcgcgctgccgttgcgcacgcagcttttgtagatgacgccggccagcggcgccagcacccgcccatcgccgccggcgaaatctatcgaatcgtagggctggctttcgccgctgtagccatgcgcgccgccggtcaggctccaggcggcgccttcctgccagggcaggcccaggccggtggcgtccggcgccagccgtttgccgcgggcagcctggctttgccaggcgcgcagctcatcattgctcagccaacctgccggcgcggcggccagcagcgcggcgaatgcctcgctgccttccggcgccacttgccagccttgcggcgtttggcgcgccaggaactggcgggatggcggcaccatgtccgccgccgcgtcgccggcaagcatcggcagcggctgggtgagcgcgcccagcacccacaggcggtccgcgctgacgcggctctcttccactaatggttccaggacctgtttggccaaggacggctgcggcgcgaacgcggcgatagctgcctggcgcagcgacaggtcgctggtctcggccgcggcgaaagcggctggcgccgccaacatggcgatccaggaggacaggcgggcaatggcgggtttcatcattacgggctccttgtctggtggcaatggccggccatgtgccggccattgccaccatatggggagcggttgctattttcatctggccttaagaggtgggcgggcgcggggaaccttttgccgcggcgcgctttgcttgcgtggatggcctgggtgatcccgacggccaatggggctatcatgttctggcaaactggccatcgtgcctgtcgttcaactcgactcaactcgaccctcttcatggccaaaccgatcagcgtgatgacgtacaacatccacaaaggcatgtcgccgctgaatcggcacctgcgggtggaggacatggctgacgcgttggccgaactggcgccagacatgctgtttttgcaggaagtgcagggaaagaacctggagcgggccttgcggcaccagcgctggccggcgcagccgcagcaccattttctggccaaccggctgtcgcaccgggcggtgtatggtctgaacgccgcctatgaccacggccatcacggcaatgccttgctgacgcgcttcgcggtgcgcgagtggtgcaaccgcgacatttccgtcaatcgctttgaaagccgcggcgtgctgcagtgcgtgctgcagccggatggctggccgcagccggtggtggcgctgtgcggccatttcaatctgctggcggcggataggcgcaagcagtacctgggtttggccagctatgtgcagcaggccatcgccgaggatttgccgctgatcctggctggcgatttcaacgactggcgtggcgaggccagcgcgctgctgtaccgcgagctggggttggaagaggcgtttttgcagactcgcggcgcgcatgcgcagagttttccggcgcggatgcctatgctgacattggaccgcatctatgtgcgcggcctgaaggtggaggcggcgcgggtcttgtcgggccggccatggtcgggcttgtccgatcatctgcctttatgcgccgaaatacgcccttgctagcccgttgccgagtcattttgataactaaaaaaactatacaaataactaggccaccgtaattcatagcgttttttgcaataacgcgacggttgcttataatttttcaaaaggtggttgacgctaagcgaaaaaacatgttcaatctcaatcaaatttatcgccgatttgaacacagcttgcgggcgtaaaacagctaaagcgtgggtaaacagacccagtcatcagaccaacctgtttacaagcaatctcccggacattccgaagattcccaccgcaaagcccgccgcagccatcggcgggctttatgcatctgggagtgttaggaatgattcatctgcaaaatgtctgcaagcggtttcccagccccgaaggcggctggttcgatgccgtggcggaaacctcgctgaccatccacgccggagaagtcttcggcctgatcggcttctccggcgctggcaagtccaccttgctgcgcctgatcaatctgctggagcgtccggacgccggcgcggtgatcgtcgacggccaagaccttaccagcctgtctcccaagcaattgcgcgccgcgcggcaaaacatcggcatggtgttccagcagttcaatctgctggccaaccgcaccgtggccggcaatgtggccttcccgctggagatcgccggctggagcaaggccgacatcgaaaagcgcgtggcggaatgcctggccatcgtcggcctggaagaccgcgccaaccactacccggcccagctgtccggcggccaaaagcaacgcgtcggcatcgcccgcgcgctggcgccccgtccgcacgtgatcctggccgacgagccgacctccgcgctcgaccccaaaaccacccagtccatcctggactgcttgaaggacatcaacgcccgtttcggcgtgacggtggtgatcgtcacccatgaaatgcatgtggtgcgcagcatttgccaccgcgccgcggtgctcgatcagggctgcgtggtggaagtcgtcgatgtgaacaatcaagaagtggccgccgattccgacttggcccgctctttgctggaggccgcgtaatggatgccgcaaccctgaacgaagcgctgcaaaacctgcaatcgatggccccggaaatctggcaggccagccaggagaccggcgtgatgctgggcctggggctggcggccgccatcctgttcggcggcccgctgggcgtcgtcctgtacctgtcgcagcagggccagatgttcgccaaccgtttcgtcaacggcgtgctcagctggctggtgaacctggtgcgttccttccccttcatcatcctgatggtgtcgctggtgccgctgacccggctgatcgtcggcagcaccatcggcccggtggccgcgtcggtgccgctggccttcgccgccattccgtactttgcccgactggtggagcagacgctgcgcgagattccgcgcggcgtggtggaggcggccgaggcgatgggcgcgagcccggcgcagatcatcttcaaggtgctggtgaacgaggctcgctccgggctgatatccagcctcaccatcctgaccatcagcttcctcagctacaccgcggtggcgggcgtggtgggcggcggcggcatcggcgacctggccatccgctacggttactaccgcttccagaccgacgtgatggtggcgatggtgctgatgctggtggtgctggtgcagatcatccagctgctgggcaaccgcctggcggccaagttggacaaacgttgagcttcagacgcgcaaatttaaaggagaaaaccatgcgtagattcgtcatcaaggcagttgcagcatccgtagtgggcctggcgctggccggcaatgccctggccgccgacccggccaagaaggaaatcgtcatcggcaccaccgtcggcgacttcggcgacatggtcaagcagtcgatcaagccgcagctggaaaagcagggctattcggtcaagctggtggagttcaccgactacgtgcgccccaatctggcgctgcaggaaggctcgctggacgtgaacgtgttccagcacaagccttacctcgacaacttcgccaaggagcacaagctgtcgctgaaagaggctttccaggtgccgaccgcgccgctgggcatctatccgggcaagctgaagtcgctgaaggacgccaagccgggcgtgaccctggccgcgcctaacgatccgtccaacttcgcccgcgcgctggtgatgctgaacgacctgggctgggtgaagctgaagccgggcgtcaacccgctgaccgcctccgagcgcgacatcgccgtcaacatcaagaaagtgaagatcgttcagctggaagccgcgcagctgccgcgctcgcgcagcgatgtggacttctccgtgatcaacggcaactacgccaccagctccggcatcaagctgaccgaagcggtctaccaggaaaagagctacgcctatgtcaactggggcgtggtgcgcgcggccgacgccgccaagccgtgggccaaggacgtgatcgccgcctacaattcgccggcgttcaaggcctacaccaagcagaaattcgccggctacaagctgccgcaaggctggaactgagtttttcttgtaacactcctggctacaagacttgacggagggctgcggccctccttttttgcgtctgttttttgccggcagggcgaagcgcggcggtgattgccaacttattctgaaaacactatcgacaaagcttgcgcggcggtgttgcttgcggcggcggcaggagggctgcgtcgggcgggcgacaaacgccggccgggcgggcatttgcgcggtgtttcatgatagaatggcgggattgttacatccatcggttgtcgttgcctgagcgccgttttgcaaacgtggcgcgcgccgggcgggcggcggccggatcatccttacgaatcaagacactatgaccgataacctgttcgccaaggaaacgattcccatcagcctcgaagaggagatgcgccgttcttatctcgattacgcgatgagcgtgatcgtgggccgcgcgctgccggacgtgcgcgacggcctcaagccggtgcaccgccgcgtgctgtatgcgatgcacgagctgtccaacgactggaaccgcgcatacaagaagtcggcccgtatcgttggcgacgtgatcggtaaataccacccgcacggcgacaccgccgtgtacgacaccatcgtgcgcatggcgcaggacttttccttgcgctacccgctggtggatggccagggcaacttcggctcggtggacggcgacaacgccgccgcgatgcgttacaccgaaatccgcatggcgcgcatcgcgcatgaactgttggccgacatcgaaaaagagacggtcgacttcggccccaactacgacggctccgagcacgagccgctgatcctgccggccaaagtcccgaacctgctggtcaacggcgcctccggcatcgccgtcggcatggccaccaacattccgccgcataacctcaacgaggtggtggacgcctgcctggccttgctgggcaacagcgaactgaccatagacgagctgattgacatcattccggcgccggactttccgaccgccggcatcatctacggcaccgccggcgtcaaggaaggctaccgcaccggccgcggccgcgtgatcatgcgtgcgcgcacccataccgaacccatcggcaagggcgaccgcgaagcgatcatcgtcgacgagattccgtatcaggtgaacaaggcccgcctgctggagcgcatcagcgaattggtgcgcgacaagcagatcgagggcatctccgacctgcgcgacgagtcggacaagtccggcatgcgcgtggtgatcgaactgaagcgcggcgaaatgccggaggtggtgctgaaccacctgtacaagatgacccagctgcaggacagcttcggcatgaatatggtggcgctggtcgacggccagccgcgcctgctgaacctgaagcagatcctggttgaattcctgcgccaccgccgcgaagtggtgacccgccgcaccatcttcgaactgaagaaggcgcgcgaacgcggccacatcctggaaggcctggccgtcgcgctgtccaacgtcgacgaaatcatcgcgctgatcaaggcgtccgacgccccgccgcaggccaaggccgcgttgatggctcgcgcctggcgctcgtcgctggtggaggacatgctgtcccgcgtcgaaggcgacaaggcgcgtccggaaaacatcgatccggctttcggcctgaaggacgacggctaccacctgtccgacgtgcaggcccaggccatcctggacatgcgcctgcagcgcctgaccggcctggagcaggacaagatcgtcggcgaataccgcgagatcatggacgtgatcctcgacctgctggacatcctggccaagcctgagcgcatcagccagatcatcggcgacgagctgaccgccatcaagctgcagttcggcgacgcgcgacgctcggaaatcgagccgtacggcggcgacatcaatatcgaagacctgatcaccccgcaggacatggtggtgaccatttcgcacagcggctacatcaaggcgcagccgatcgacgactacagcgcgcagcgccgcggcggccgcggcaagcaggccgccgccaccaaggacgacgatttcatcgaaacgctgttcgtcgccaacacccacgactacgtgctgtgcttctccagccgcggccgctgctactggcgcaaggtgtacgacctgccgcagggcggccgccagagccgcggcaagccgatggtcaacgtgctgccgctggaagacggcgagaagatcaatgcgctgctgccgatcagcgagttccgcgacgatcaatacgtgttcatggccacggccgacggcacggtgaagaaaacgccgctgcgcgccttctccaagccgcgcgcggccggcatcatcgccatcaatctggacgaaggcaattatctggtcggcgtggcgctgacctgcggcaagagcgtggccggccagggagatgaggaagacgaagtggcgtccgaagacgacaccatcatcgagggcgagctgatcgaggacgcgcagtccatcgaaggcgatcaggtgatgttgttctccgacgccggcaaatcggtgcgcttcagcgaaagccaagtgcgtccgatgggccgcacctcgcgcggcgtgcgcggcatgaagctgggcgaaggccagaagctgatctcgctgctggtgaccaactccgcggaccagatggtactcaccgccagcgacggcggctacggcaagcgcacccgcgtcagcgacttccgcctgaccagccgcggcacccagggcgtgatcgcgatggacctgaccgacaagaccggcttcaagctggtggcggccagcctggtggaggaaagcgacgacatcatgctgatcaccaccggcggcgtgctgatccgcaccaaggtggcggaagtgcgcgaaaccggccgttcggcccagggcgtgcgcctgatcaatctggacgacggcgaaaagctgatcggcctggagatcgtggccgaagccgagtgcgcggatgccgaaggcgagggcgatgccgcgccggagcagggcgaagcgtaatgatcccgactcctgccaacccgcaggtgctggaggcgatgagccagctcttcgtctccttccctcattgcgcgacgctgggcttcgagtatgtcggcaccgagggccgcaagcccacgctgaagctgtcctggcgcgaagacctggtgggcaatcccgccaccggcatcctccacggcggggtgatcacctcgctggtggatacctgcagcgccatcgccgtcaccgcgcagctgccgggggcggaaaccatcgccacgctggatctgcgcatcgattacctgaagtccgccacgccgggcaaggccatccactgcactgccggatgctaccggctggccagccagatcgccttcacccgcgcggtgtgctatcacgataatccgaccgaccccatcgcccacggcgtggccaccttcatgcgcgagtccagccggacgccgatgctgccggaggagggccgcgaatgagcgaattcatgcaacgcttcgccgaatggcgcgagcgcaaggcttacgccgagatcgtggacgcgctgccgtatgtcaagttgatgggagtgcagctgcgcgaggacgaacagggcgagctgcgcttcgatctgcctttcgccgagcgcaacgtcggcaataccacgctgccggcgctgcatggcggcctcataggcggcttcatggaaagcgcggcgatgatacacctgatgtggaaccgcgagtcgctggaagcgccgaagatagtggatttctctctggactacctgcgcccggggcgcccgcaaacgctgagcgcccagtgcgaaatcaccaagcagggcaaacgggtggcccacgtgctgatagaagcctggcaagacgaccgccgcaagccggtcgccgtggcccgcgcccattttctgctgagcaactgagccgcccgcgatggcggcccatggaaaaccggcgcatccctggcgggacgtgccggtttttttatacactcgtagcgacagccgcagccggctgaccccgcgcacgcaatagataaaggatagacatggccaaggtttacaacttttccgccggtcccgccgtcctgccgcaccaggtgctggccgaagcccagagcgaactgctggactggcacggctccggcatgagcgtgatggagatgagccaccgcggcaaggaattcatgagcatcatccatgacgccgagcatgatctgcgcgagttgatgcggattcccgccaattacaaggtgctgttcctgcagggcggcgcttcgctgcagttcgcgatggcgccgctgaacctgctgggcgacaaggacagcgtcgacatcgtcaacaccggccattggtccaagctggccatcaaggaggcgaagcgctacgccaaggtcaatgtggtggccagcagcgaagaccgcgacttcagcctggtgccggaagaggcgagctggcagcgcgatcccaatgccgcctacctgcactacacctccaacgaaaccatcggcggcctgcagttcccctatgtgccgggttcgctgcctggcgtgccgctgatctgcgacatgtcgtcagatttcctgtcgcgcgaggtggacgtcagccgcttcggcatgatctacgccggcgcgcagaaaaacatcggcccgtccggcctgacggtgctggtgatccgcgaagacctgctgggcaaggccagggcggacattcccaccatgatgaattaccaggtgcatgccgacgccgactcgatgtacaacacgcccggcacctacccgatctacatcgccggactggtgttcaaatggctgaaggagcaaggcggcgtcaagggcatcgccacccgcaacgaagagaaggccggcctcttgtaccatgcgatagacagcagcgaaggcttttactccagccatatcgaagcgccgttccgctccaggatgaacgtggtgttcaagctgaaggacgaggcgctggacgaaatcttcctgctggaagcgcgcaagaacggcctggcccaattgaagggccaccgcgcggtgggcggcatgcgggcgtcgatctacaatgcgatgccgatcgagggcgtgaaatcgctggtcaatttcatgcaggatttcgcgcgccagcatagctgaccgtagaacgtcgtctggccgaatgcgccgccgccgtgaccgtcatggcggcggcggattttttccctgcttgtcgttggtgcagctgggatagggaggcgcttcgccaggcgtgcggttgcaaagcctgatcggttcgactaaaagctggtaacgggcggtccatttatcggtgtcgataggcagcggcgcgctcgaggggctggatcgctccgcccattgcacggtgtaatagtcgcgcgcccccttgatgacggtgatcagcgccgattcgctggtgcgcccgcctgtggccggcgaagtgccgcattgcatcagcatggtgaaagcgtcgtatccgtccagtttgccttgtcgcaaggcctgggcgctgaacgagtccgggcagtcttttttaaacccgccggctatcgccatagccagttttggcagcgtgacgttgggattcagcgccagatctttcctgccggttagcgtgatcatttgcgaccatcgttccaccgtttctccactcaggaccgactcctggatataggcgacaggttttgcctcttcataggcttgatcgaaaccccgaggcatgggcactagcagcaattggctgtaaatcggggtgatggttttgaccgaatagcctggcgcggcagtgggtctgcttgccgccggcttggcgtcgtcggctgcggcgaaagcggagtatccccaaaaagcgcagcatagcgcgccgatgatggcttggtttcgcatggttgcgtagcgccggtgatgaacgtgggtgtttgcggccgcgtctggccattgagatggcgaagcggaatgatagcgcccaagcaacccgcctccaagttcgccgtggggaaagctgcggtgccggagcttagcgcgccttgggctcggcgctggcttgcagcgccagccggatgcctcggctgatgttgccgtcgcccaacgccagcgcgatgtctatgctttgcgcgtcgagatagacattgcggcgcgcgccgccttgcatcttgagcggcgcgccggcattgctgcctatgcccagcgcctttttcacctgccgctgatccagcggacgcagcatgctcgaattgaccatgctgtagacgccgttgctgtatttgcgcaccagcgcgccgctgcggccggccagtgtgatcacgcccaccacctcgtagccgggcaagtcgtccagctgatacagcctgggccggccgggttgttcgatatggatccgatgtccgtgattgtcgcgcatggcatgctccgcttggatcggcaagccctaagaatgaggatttctgcctgccataatcaattttgtacacacccaatcaaagcgcaagccaaaaatatgtgtgtatgaaaaaaacggcatccatgagatttggcgctgcttaaaagaagaagcccggcggggccgggctgctgaatggatgggaggcgctatggcttggcggcgctatccgcttcgcgcggcttggcgtgcttgacatactgatccagccagcggtcctcctcccacagcatgtgcagaatggactcgcgggcgcggtaaccgtggctttccgccggcagcatcaccaagcgggcagtgccgcccaggccctgcagcgcctggtacatccgctcgctctggatcgggaaagtgccgggattgttgtcggcctcgccgtgtatcatcagcagcgcgtccttgatctggtctgcgtaattgaacggcgacatggtctggtacacgtccttggcctgccagaagttgcgctcttcggattggaagccgaacggcgtcagcgtgcggttgaaagcgccggagcgggcgatgccggcgcggaacagccgggtgtgcgccagcaggttggcggtcatgaaggagccgtaggagtggccgccgatggcgatgcggtcgcggtcggcgacgcccagcctcaccacctcatccaccgccgcctgcgcgtccattttcagctgcggcaggtagctatcgttcggctccttgctgccttcgcctacgatcggcatggtggggtcgtccagcaccgcatagccgcgggcgagcaagggctccggtccccagtagccgatgcggttgaagcggtacggcgaatcggtgacctggctggcggcctcggcgctcttgaattcagccgggtaggcccacatcagcatcggcagcgggccgtcgcgcttggcgtcgtagccgggcggcagatacagggtggcggttaggtcgacgccgtccgcgcgcttgtagcgcagctgccgcttctgcacgcccttgagttggggcgtggggtgggtgaagaaggtcagctggcgcaggccgtcattctgtcccaatgttttgatatacagattggctggctgctccacctgctcgcggctgagcagcgccttgccgctgctcagcactgccagcggctgttcgaaccacggcgcctgcgagcgccacagccgactgctttgcttggttttcagactgaatgcgtcgatgaaggggcggtcgccttccggactggcgccgtcgcccagcaggtagaggctgtcgccgtcggcgctggtttgcagcagcgactggccccggccgttgctgatcatcgccggcacgcccggatcggcgtaacggtcttcggatttacggctgttcagcaattccgcggcctggccggggcgacccggctggatgcgccaggtcttgatgtcacgagttttccaccagtattcgctgaccagcgccagatcgtcgcggccccactggatgtcggcgaaacggctggccagctcctgcagtttgagcggcggcttggtgaacggcgccgcttgcaggtacagggcatcccggaccttggccgccgcggccggatcgccgccgtcctgggcttcggcccagaacagcgacgccggcgcgtcggcgcgccactccacttcgcgcgggccggtttccaccgcgtcgttgccggaaggcaggcgctccagcagcgggcgctgtgtcactaggtggacgctgcggcccttcatgtccagcacttctatccgttgcgggaagcggctgatcggcaccagcgtggagtaggggcgctgcaagcgcaccgacagcaggtattgccggtcgggcgatgggcgcaccgccaggtagcggtcgggtttgccgatgcggtttgccttgccgttcaggtccaccagcgccagctggctggtcagctcgtaatccagcaagtcggcgtcataaggggttttcagcaggtcaggataagtgcgggtttgcgacagcttgccacccaggctttgctggatgttggggccggccgggatcgtcggcttctccggcgccgggccttgctcggcggggcgcagcttcgccagcaattgcgagcccaaccaggagaatcccgcgccgctgctggcgttgagatggaagctgcccagccggtgcgcccgcgcctgggagacgtccagcagccacaactccacgcctttgtcgccccacaggctcagcgccacccgtttgccgtccggcgaccattggctgtcggcgatgcgcggggaagccggcaggccggagaccgggcggctcttgccgtcggccagagtgagcagggtcagcgccgtgccgaattcgaaacggctgccggcatgcatcctgggattcagccgcaagccggccagccgcagctccggctgcgatacgtcagcgatgccgggcaggccggggcggtggatttgcaaaatggtgtcgcgctgagggttgagcgactgcgacggcgtgcgcggcgcatcgacgatggccgccagctccgacggcggcgtttggtagccgctttccgccgcgaggcaaggggacagcaaaccggccagaaccaggccggccaagggttggtgattacgggccatgcagtctccagattaggacaatgccgctgactgggcggaaagcagccaaactgcaccactcgcgccgcgcagtcaagcgcttggcatgttgccttaggccaactgggtgcccagcatggcgtccggctgcaatcccgccggcgagagagtggggtagtcgaagaattgcaggctcaggccgccgccatcggaatggaagcgcgccggatagcccagcggcagcgtggtcttgttggcgatgtggccgaaaggcacgccggtgaagaccggcacgccgctgatgcgccgcagctcggccaccaccgcgtcgaagttgtaatgcggatcgtagacgtcgacatgcttttgcatcgagaagtcgccgaggaaaatggctttctggcgcgacagcacgccggccagatgcaattgctgcagcatgcgctccacccggtacggctgttcgccgacatcctccaaaaacagcaggccgccctggatttccggcagatagggcgtgccggccaggctggacagcacgctgaggttgccgccccagaaaatgccttcgccgcggccttggggctgcggttgcgccgccgcgatgcgcaggctgcgttgcggcgtggtgatcgcgctgaagaactcgttgatggcataagggctggggctgggggcgccgaaatcgcccagcatcgggccggcgaagctgccgacgccgctcttggccagcaccgccaactggatggcgcaaaaatcgctgtagcccaccagtgaggatcgggactccttcagccgcgcccccagccgcgagaagtctaggtgcggcagcagccgcatcgcgccatagccgcctcgagccgccaagaccagcggcggcaattgcggttcggtcagcagggtttgcaaatcgctcagccgctgggcgtcggtgccggcgaagcgttgatggctgcgttcgagcgcggcggtgttttccagctggaagcctgcctgggccagccgcggcagcgccagctggcgttgcttcggcggcacgatgccggagcaggcggtcaggtagaggcgggtgttggcgacgcgggtgggcagggcgttttgatccggcatagagcggcatccttgcaggatcccggcgccggccccgagggcaaggcactgcagcagctgacggcgggaatgattgatgtctggtgtcatggaagtcggacggggcggccggctgggagttccgggcctggcgctggtggcggaatggccaagagtatacggcaaaagaaaaggcggcctccagcatgaaggccgcccgggagaggaaaaggtatcagccgaccagattggccatgctggtggaagcttgctccatctgcgccagttcgctgttgagattggagtattccgtcagcaggctgctctgctcattggagagctggctttgcagctggctttgcaattgctgttcgctggtcacctgggaattcaggttgttttggtcgatggttaccaagccggtcggtcctagcagattgttgatggcggtgttgaagacgttgccgatgccggtgttctgggcgttgccgaacagattggtcaccgcgcccgggttcgacgacagcgccgaattgaaggtggtggaattcagcgccagcgtgccgtcggcgttctgggtgatgcccacttgcgccaagtaggcgaaggagttgaccggatcggcgccggccaccggagtgccgaggatcccggcgagctgttcctgcaggccggtcagatcgctgctgatgtcggtattggccggcgtgctgcccacggtcttcgagctggtggtggcggagttggtcgccgacaccacctggttgtaggccgagacgaaggtctgcagcgtggaggtgatgttggcggtattctggctcatgttcaccgtcacctggcccaatttttccagattgaccgtcgcgccggtaatcacattgctgacggcattgctgctggacgacacgttgacgccgttcacggtcatcagcgcgttttgcgcattggtcgactcggtggccgcggtgctgctttgctgcagtccggcgagggtgttgcccgaggtgccgttgctgtcggtgccgccggcggtgatggtaaaggcattgctggggccagcctgggcggagttgagcaccagcgagtagttgttgttgtactgcacgatggaggcgttcacgccgatgccggcgccgttgatgctgctggcgatggaggacagcgttaccggactgccgccattgctcaggttgaccgtgctgctggtgccgccgatgttgaaagtcagcgaactgggcgcgccgctcagcgccgcgttttcattggtgatgggcgaaccgttggagttctggtcgaaaaccagctgccgggcttgcgccagctgggtcacgttcaatacgtaggagccggcggtgccgcccgaggtcgtggagacattggctaccgtgctgtccgacgaggttgcggcgaattgctgcagaaaggtgccggacgacagggtggtcgccgcggtctgcagcgcggacaaggcggagctgacctggccgagcgtgctcagttcggactggtaattggagacgcgctgctggctttgggtaagcggctgcgaatcggcggcgaccagctggctgacaatggactggacgtccagcgggccgacgttactgctgatggatgaagctgacatgacgtcgtctcccaaaccccggtctgatctgccatcaggccggcatgttgcaaagtagggcgaatgagctgccaagctgtcatcacggacgggtgctgctgtcgttgttttggtaaagttctttgaatcgctatcggccggtttggcggcaacttgagcctcttgccggctttttttcatgttacaccgcttgccaggcggcttgctggcggaaacgtttattcttcgatttcatattttaagatttgctaagtttatattgatatatccaatcggttttgaacgtccccggatgtttccggtagattgagtccatcaaagaacaggctgcaagcatggatatcgatcaagcaaggctgactcacctgcaacaactggaagccgagtccatccacatcatccgcgaggtggcggcggaattcgaaaacccggtgatgctttactccatcggcaaggattcggcggtgatgctgcatctagccaagaaagctttctatccgggcaagccgccgttcccgctgatgcacgtggacaccacctggaaattccgcgacatgatcgcgctgcgcgacaagcaggccaaggaaaacggctgggatctgatcatccatgtcaatcaggacggcgtggacgcaggcatcaatcccttcaccgccggtagcgccaagcacaccgacgtgatgaagaccgaaggcctgaagcaggcgctgaacaagcacaagttcgacgcggccttcggcggcgcgcgccgcgacgaggaaaaaagccgcgccaaggagcgcgtttactcttttcgcgacaagaaccaccgctgggacccgaaaaaccagcggcctgaattgtggaacatctacaacggcaagatagataagggcgagagcatccgcgtgttcccgctgtccaactggaccgagctggacatctggcaatacatctacctggaaaacatcgagatcgtgccgctgtatttcgccgccgagcggccggtggtggagcgagacggcatgctgatcatgatcgacgatgatcgcattctcgaatatctgacgccggaagaaaaagctcgcatcgaaacccgcaaggtgcgcttccgcaccctgggttgctacccgctgaccggggcggtggagtccgccgccgcctccttgcccgaagtgatacaggaaatgctgctgacgcgcacttcagagcggcagggccggctgatcgaccatgacagcgccggctcgatggaaaagaagaaaatggaagggtatttctgatgtcgcatcaatccgaactgatttccggggacatcctggaatacctgcgccagcatgaaaacaaggacatgctgcgcttcatcacctgtggcagcgtggatgatggcaagtccacgctgatagggcgcttgctgcacgattccaagctgatcttcgaagaccagttggcagcgatagagcgcgattccaaaaaatacaacaccaccgatcagaacatcgatctagcgctgctggtcgacggcctgcaggcggagcgcgagcagggcatcaccatcgatgtcgcctaccgctatttcagcaccgacaagcgcaaattcatcatcgccgattgcccgggccacgagcagtacacccgcaatatggccaccggcgcatccaccagcaacctggccatcattctgatcgacgcgcggcgcggcgtgcagacgcagacccgccgccacagttacatcgtcagcttgctgggcatccgccacgtcatcgtcgcggtcaacaagatggacctggtggattacgacgaaagcgtgttcaaccgcatccgcgacgactacctgacttttgccgaacacctggacattcccgacatccatttcgtgccgctgtccgcgctgcgcggcgacaatgtggtcagccgcagcgaggccgctccctggtaccaggggccgaccctgatgcacctgttggaaaccatccaggtcagccatgatgtggcgctggatgcgttccggctgccggtgcagtatgtcaaccggcccaatctggacttccgcggcttctgcggcacggtggcgtctggcagcatccaccccggcgaccgcgtcgtggcgctgccttccggcaagcaaagccgggtgaaggaaatcgtcacttacggcggccaattgccgagagcctcgtcgggccaggcgatcacgctgaccctggaggatgagatcgatatctcgcgcggcgacatgctggtaagggccgacgaggcggcgcctcatgtatcgcagagtttcgacgcgcatctggtagccatgggcgaaacaccgctacggccgggcaaggagtatggtttcaaactggccggcaaatacgtgactggccgcattgagtcgatcctgcaccgcaccgatgtcaatacgctgcaaaacggcccggccgaggcgctggcgctgaacgagataggtctgtgccgcatttccctcaatagcctcgcggttttcgactcctaccgcagttgccgcggcagcggcagcctgattctgatcgatcggctgagcaatggcaccgtggccgccgggatgataggccagacagtggaaagcgctgtcgacagccagtcgccctggcaacggttcgagcaggaactgagccagttgctgcgcaagcattatccagacatgaccttggctcagttggcgcagcgcttggcagagcgcgccggagactgactcccgatacgcccaaaacagccccggcatgccggggctgtttgcttccctgagaatgcctgggagcggaagtgccgtatatgctgcgagatgggggcgggcacggctttaatcggcgcgggcgcgttgaggcggcaagcatctataagttcgcataatctgtgattttgtcatatccgaatggtataaattagacgccatagacttttcggatattgttgcgcctgcgcctatcgtaatcgctaggaacaaagcggcaacgcgctgcgaataccgaaaaaaaacgctcttcaggtactcccgctgtgcttcgtccttggtttgttcgtatgctaaacaagtacatacctcgcgatggtcctgtcctagtaggtctgcgattatgtatcctgttgctggtgggggatttcgttttccttcgagcatatatcctatttttgtagggtcgataagcagtagttttgctactgcataatcgctctcaactccttgttttttcttgatttcctgtacgtattcaaagaacgttttcattgtctactgtcctttttggcatattgtaatccccaatagggaatagtctatcattcgactattccccaatagggaatattttctgtctatccactaggtcgaaaggttcccaaatgtccgaagttgccgctgctcccgccccgcaaaaacaggctcttggtccgaatcagtgcgtagtcctgggccgcatcaaagagcgccgttctcataacggctacatcttcaccaccatcatccagcctgctgcagacgaatacagcatgcccggcatcgtggaagtccgttccaagaagtcgctcggtcaggtaggcgatgatgttcgccatctgtgccagtgctctggctacacgaacaagccgttcgagagccgcgacaaggaaacgggtgaagtggttatccgccgtaccgtctccaacgttttcattgctatcgaatgatagcagcgatcacagccagttattggcactgcacggcgtaggggctccgcccccgcgtgcagtgcaataactggcgtgtttgaggtctcgccatggctcagtgtgtatttgtttctgctgatggctcgttggctttcacggctgacagttcccagtcgtgtcagggttatctcttgctcacgcctcaagaggtggccagtttgcagtcgccgtttcgcccgctttccattgcagagggcagcgctatttcggttgccatcattggtttgtggggtgcggcatggttatggcgtgtgataggtaattccatttcttcaccatctggagagtcatcatgaaattccgttccgttgccaagaagttcgccccccgcatcaatgtgaagcacgccgttttcgcgctggccgctgctccgctggccgccttcgctgacggcactggcgcgccggacgtgtccacggtcgtggccgccatcgtcgccggtggtgtagccatcgcgctgatcggcaatgccaagtcgggcgtccaggctgtgatggcgctgtggggcatgatcaagggtgctatcggccgcggctaacgcctgggcatctacctgctgattagaggggcgtccgcgcccctcgtttttttaggggagtgcaatgtggcgggctacttcattattttggctttgtgcggtgcttcttggattttgttccggtagtgcgcgcgccgattccacctatcctgcccatgtcacctatacgtggtatggccagacgttcggctctatggatgccgtcgctgctgcctgcgccaatacgctgttaaatggtcagggcggtgtgtggtccggctacagctgcatttttggcggtgtcagtttgtttccgtccacgtcctacagctgcgattctgacgacagcctggacgcgaacgggcagtgccacaaagctggcccgccgcctccgccgcaatgtccctccccggatgtcatggccatcacctgcatggcgattaaagggacgcaccagaagtccggcatgatcacgcctaccagcgggccgggctgcgatacgggcggcggcagtcccgatatgcagcgctgtggcgccggctgctccatgacgacgcaaacggtcgtcacgcctaccgcctcctatatggaccacgtctataacggtgccgcgtgtacgccgggcggtggcgtctcgaatccgggcgggttcgtccccacgccgccgacgaatcaggtctgcggcaataatcaggtttacggggaaataaacggcacgcccacgtgtgtggacaacgctcaaaaaccgggcactcagccccctgagactacgtctcccgactcatgccctcagggttcggtcgcgctcatcagcccgacgactggcaagcccattgcctgcattgacccgcatgactcgtctacgccatgccccagcggtcaatactccgtctctcagggaggtagcacgatctgcatgggctcgccgtccaatcccacgccatccagcccggccggcacgggctcgtcgtctggccattctggcagttcgtccggctccagtggttccagcggctcgtctggctcctccggctctacgggctccaatggtggcaaacccggcgatggctccaaaccgcctgatagctccgctccgcagcctgagacctgcgacgacaaattcccggatggtctgaagtggatttgcgggctcggcgcgggcctctccggcccggacggctccgacaaattgacgacgcaatcgggcggggatgtttccgggatgctggacacgtccgacatgtttggcggtggcagctgcccggcggtcaatcatttggtcgttccggttggggattctaatttcacatgggatatcgattacggcccgttctgccatttcgttttgatgatgaagccggggattatcgccatcgccatgctatcggccttattcatcatatttaagcgaggagggtaatctcatgccggtttggctcgttcccttattgtggggcgtcgtgaatgcgttgctgtattcagtgatcgcccgcatcattaccgcgctaggtattggtgccatctcgtttctcggcgctaatgccattctctccaaagtgaagagcgctattcagtccgttgccacgggccttccagctgacgcattgaatatattgggcatgtccgggctcggcatcgcgttctcaatcattctgagcgcattcgccatccgcatgacgttggatggtgtggacagtgccggcaattttgttacaacgaaattcagcggatttggaggttccaaatgatttacttggtcacggcggttcccggctccggcaaatcgttgtatacgctggattggctgcgcaagaaatccgacaacgagtctcgacaggtctactacaacaatattccgctcagcaaaacgggattggatttgttgcagtggatagaatttcctgacccgactaaatggatgcatctcccgcccggcgctattttcgtgatggatgaatgccagttctcgttcccggttcgcaaatccggcaaagacacaccggagcacatcgagaagttttcaacgcaccggcatttgggcatcgacatcgttcttattactcagcatcccggtctgctggattcattcatccgccgcttggtgggtacgcatattcatttggttcggcaattcggcgcggaacgctccacggttttgacgtggcaagagggatgtcaagagaatccgaactccaagagcgcgcaaaaggcctgccttgatcgcaggacgtttgtttttccgaaagaggtatattcgtggtacaagtccgcagaggcgcatacgcataaattccaaatgcctctgcgcctgaagcaaatgattatgtggttgattgcggtggttttcctgattgccgcgtctgtctggtatctctatcacaacatgattgccaagcctcgcgaagaggctgagcgcctccagaataaaaccaatgcttcacagccagtctctcaaacgccttcgcctcaacagtcacaaaatgcagggcagggcggcaactcgaatcagcgcattatcaaaacggctcaaacgtttctacaggatcgtcagcctcgcgtggacggcattcctgaatccgctcccgcttacgacgaattgaccacgcctaaaactttcccaaaggtcacggcgtgcgttgccagtaattcgaaatgctcttgctacaaccagcagggcggtttgattcagatggatgattaccgctgtcgctattatgtcgacaaaggctggtttgacccgtatatggacaaaggggaaatgcaggacagacagattatggcctctcggcaaaacgcctctgctcctgctgccattgctcgccaaaagccagcccgtcccgaagtgctggctatgtccagttcgaacattttccctcgcattgatcaacgaaaaggaaattgacatgaacaatcagccgacgattaccttaagtcaggccattggccatttgaaggcgagtggttttcaggccaacggtatgcaggttctcgcctatatcgcctcattcaacgccgccatggagttttaccgccagcaggtaggggagaggcagagcatggacgttgccactcaggatgcttcgcaatgattcccgcatcgtcgattgctcagttgcttgttgccgtggcggtttgctcggcgattatctcggtgctcatgtttgttttgcttcagcatttgaggccgttttttcggcgtctgctgcgacggatttttcgttgactgtgactggccggccgtgactcgtcctggacaagtcacgccaggtgagtcacacttcttttgtgactcacctggtggagcctgcttcatgtcgtcacagttgattctgagcttgtttccgggcattgacctgtttggccgcggttttgaggctgagggtttctgcgttgttcgagggcctgacgttatctacggtggtgatatccgtagttttcatcctgtgtctggccgtttcgatggcgtcattggcggtccgccatgtccagatttcagccgcgctcagcgaggcgagccgacaggctacggcctggagatgctggaggagttccgccgctgtgttgtggccgcctcgccgctctggtggcttatggaaaacgtctccggcgttccagacatgcgcatcgacggttacagccaccagcgcattgacatcaacgcttccgagtgcggtttgcagcagaatcgcctccggcatttccagtttggccatcgtgctggtttgattctgaccgtccagcgccagcaggcgcgtgctgatgtcgagccgtgctgcactgccagcgagggttcgcagttggggcggcgtgattggctccgcttttgccagttgcaggggctgcatgatggtattgacctgccttccttcacgctctccgctcgctatcgcgctgttggcaatggcgttccggtggatatggctcggatgctggcgcgcggcgtgttgtcgctccgctctccggatgatgtccgggtctgcgagtgtggctgtggtcgcgaggttgagggtagggcgcgtctggccacgatggcgtgccgccagcgcgtcagccgtcgtcgtcgtgtgacagatcctggatcgttggcgatcgtctagtcactgtgactgtgccggcatgactcgtaccaggtccgtcaccgtgactgacctggtgcggctcctccccgggcggtcacagtgactgagctgcggtgactcggcgccggccagtcactccagctcggtcacagtagaacctcagccgctgcctttcctgcagaccttcaaaaacctctcggcgtatgccaagcctcaccagcccccccgaagggccgctagggacccgccccggacgttgtttgtccggggaaggggtagcggggctaggccgcgcttttgcggccgtagcagggcgcagcggtgggcagcgtatcgcgcagcgtcactagctgacccccgtcctgtaacacgggggtcaacccccctccaaggctccgagacgggcgcgtctcggccctgaatttccctgccttttgttgcgggtgtgtttcgtccgccttgaattcattcccttttagggattaatatgcaaagtgttttaggcctgcccaacgttggaagcgttgcgcacggctgaaaaagcgaaagcccggcatgttggaagcatggccgggcgttcttgaactcaaccgtcgagaccggttaagcccatgcctgaattataccagccattcaaggcgcttcaagcgtcttgtgcgtccatcgctcagtctgagcgcctcgatgttgaccactggcacgccgccgccattcgctgccagtctctcgattctggcggccagccgctgcccctcaaattggactatttgaccctgattgccgactccctggacagcgacagcgttcaagagcagctgacccttcatcgacttcacctgacgccacgcaaggccaaattcggctatcaacgcggcgtctcggtgcacctacaggaattttgccttgatgatccggtgttcgaggtgttctggggcggcgacagccagcgcggcacgatgatgtttgatcgctccgggccactgtcggcgcttgctgccggcatcctgtgccgcatcttcggtgctgagcagtttcgcctttcgcgtgctgatgtggcgcttgatctgcaatacccggactgttatcgcgaggtgaagtcgtttctcgatcagcagttctcggattggcatataggcggtcgcggcggccagaagccggcgtatcgagagatttccgattgtgggacgggaaagggctgcactacgtatctgggctccggcgatgtccacatgctgcgcgcctacgagaaaggcaagcagcttcagcgcctggacgcgcttgactgggtgcgcgtggaagtacagctgaggccaggcaagcgcccggcgcagtttctggcttggagcgccgtcgctgccggccggtttttccagatttggcagatgacgccgtatgttcggttctcggattacttcttgtgccagcaggccggccgcatcatggctgagcagccgtcgcgcgactcggcattggaggcgaaggctaagcacttggtcacgcaatactacggcgtgatgcagcagctagttggccttcacgcgcatggcgactggtctgagcttggtaatatcattcagcgtgtgaagggtgcgcttgatgctggcagcggctctacgtggcatgtggaacaagcgcttttggatcagtctacgggtcagacgcttgtagaattttctgattctgatggttcgcataatctatattatgtcaaattgacgatacggataaaaacgacgaaaactgcacccgcaacaacaaagagccccgcccgccggggctcaataatttgcggagcccatgcaatgaaacgacgagtgttcagccctaggacgaattttgcatggaccaatggaactggcagtgttgtgatgttcaccagcgacgataaggcaactgcacgaagaatacgagcgtgaccgggaacgcatgggaccgtggcgaggcttcgttggccagcccgccatcattagccctgcccgcaccgaccatccagcgggtgccagtcatcagctaccaaccaacaagactcaccccatcatgcgcggaaatacgtcaccagcgcgactactacaggtcaaccatggagctgaatagcaccatcaaagaaaaagatgttaagaagtgttcaagtggagcaagcgaggaaatggataaacgagagtgcagaatataaagcgataaaataattcattaacggacaggcctatctggaattgaaactaaaaaataacgtctatatcatccagtccagccgcatcaatggtggtgtatggctaattaaaaggatttaacaatgactcttcccgcaggtacaaaggcaagaactggtgaaaaatgccctcaaggtggcgtatggcatccggttggaaacacgaaagaaactcgatcaatcggtatcggaaatgtaatgccaccgaccccaaataaagaaacccattgggtgctcaagaccccgactggtgataaaaaataacgtaataccatacgcaaagataagccgccttcaggcggctttttgcttcatcaatagaataggtctgcgccctgctatggccgcaaaaacgcggcctagtcccgctaccccttccccggacacaaaccgtccggggcgggtccctagcggccctgtcggggggctggaaggtctatagaaacctgccagaggttcaccgagatagacgtcgactattagatgcagcaatatgccagcccgtaatagatggcaaccattcttcatatctgcttgcgatagaaagcgcatcatccgggcttaaagaagttaggctgcggccacagagcgtggaatttaaaacgcgcttaaagtcatcgcagataaaataggcaaaaccaccaccacaacgttccgagcaaaaaagaccattacattccaaaactgatgaaataaaccaagaaggcaggccaaaggcggaaatgttattacatattgaagctgtaaatttctcttcggaaatcaacccaatcaagaggtcttttgcctcaattatgacacaagcaatttcatattgatctggaacagatatggaaatggtcatgtaagagcctcgtcttggggtaagtgtattgtaatggtagtcaatagaattttccataatccacaagcaaacgctacccttgatagaaaatccgtcgcagcagccgccgaaaatacggcctcaagtcatccagcaaaacgaacatgagcacagcgataatcgccgatcaaacaaacacggcaaccagtaactgagcgacagccgatgccggaatcattgcgaaacctccggcgtagcaatatccatgctctgcctctcccctacctgctggcggtaaaactccatggcggcgttaaatgaggcgataaatgcgggtcaagccaactcttgccaacataatggaaaccgagttgggaggtcatccgcataaaatttttcgcaaaattacaccgtcagcatgaattgcatatttgcgcctctatcatacagccttgccatttcaccaagtttccatcttgaatgatgctgatgtgaaaagtacaatccgcggcttttgcgttttttctcaggtttgcatgcaactgacggacaacgcgttttttcaggcggcaagacttgtattttcacttcaccgacagacacgcaaatcgtctgccaaaacgctttgccctcgctattgcctttttgctgatatccgccgacgccgcagcacaggaaaccagcaacagcatcaatccattcggcaacacgcagatggaaaatcggataaaagattttcccaagctgaaggttaccgccgatatcgcctcgatcagcgatatccaccaagcctgcggcatgacgcgctggatatgggtcattggcgctttcatgcaaggctgcaccagcttcgaccaggacatgcaatgggcgcatatccgcattgcgaaattcgccgccacccgcgacctgcgccatgaagtcgcgcatacctgcggcgagtatcacggcgacgcgatgccgcgctatgtggaaaactggaaacatcgggtgaactggcaaccccgcaccgacaatcgctgctcgccgcaatacgaagcggaaacctaccagcatctttatcaggcgctgaagcaggcaggctggcagccctgcgacgaagagcacgaacgactggcccaggaccgcacccgccgcggcggctgaactcgccgccccctgccctgcccgacatgcaaaactaggctgccgacgccgggctttttaacgctccagcacatagcgtcccggcgccggttctagcggtggatattgcgcgcaacccagcgcgggcaccgccgacagcgtgcccgactgtttgcctaaccattcctcccacgcctcccaccatgacccattttgcggagcggttgtttgcagccacgtgtccgggtcgatatagcggtcttcgctgcggcaggccgacaagcgaaaatacctgccgggatggcccggctcgctcacaatgcctgcattgtgtccgccgctggcgaggagaaactggctgtcggtatccaatgccaacttgatcttgtgaacggaacgccagggcgcgacgtggtctttttccgtggccaccacgaacaccggcgcccggatgtcgtgcagcaccaccggccggccatctacctgatagcgcccttcaaacaaatcattgtcgagaaacagtcgccgcaggtattcgctgtgcatgcggcacggcatgcgcgtgctgtcggcattccaggccatcaggtccgtcagcggctcgcgcttgcccagcagatactcctgcaccatctgcgaccaaatcagatcattggagcgcagcaactgaaaggcgctggccatttgcttggcgtccaggtagccatggtcccacatgatgtcttccagaaaggcgatctggctttcgtcgatgaacaacgtcaattcgccggcctcggtgaagtcgacttgcgccgccagcagcgtgatcgattggatgacggaatggttctcgcgcgccaggtaagctgcggtgatggccagcaaggtgccgccaaggcagtagccgatggcgttgacccggcaatcaggcaggattcggccgatgacgtccagcgcatccaatatgccgaggcgcaggtagtcgtccatccccagattgcggtcttccgctccgggattgcgccaggagatcatgaatacggtgtagcctttccctaccagataacgcaccagggaattgcgcggcgataggtccaggatgtagtacttcatgatccaggcggggatgaacagcacgggctgcgtcctcacccgcggcgtgcagggcgagtactggatcaattccatcaggtggttgcggaagacaaccttgccgggcgtggcagccaccgtttcgccgggaatgaactgctccgcgccgcatggcggcagccctgccctgcggcgctcccaatcctcctggaggttgcgccagccgcgcagcagattttgtcccccctcgagaaaagtggcctcttgcaccagaggattggtggccagaaaattcaccggggaaatcatgtccagcaactggcgcgccacgaaggacaccacctgctcatgatggggggatacgccgcggatgctggtggtggcgttgagccaccattgctgctgcagcaaaaaggcttgcgaatacaagttgaacggccagcgctgccaggcctcgtcgctgaagcgcttgtcctgctcatgaggcgcgatgcagggcgcgcaagccgagtcgaggcaagcgcgcggcagataatgcgtaagcttggcccacttgccagtgccgttctccgccaggtgcgcccattttccaggcgatatggcgaagtgtgtcgcccaatcgtaaaaagccagcgcgaggctggctggggaaatgcccagcgtggcgcgcgacatctgggcatgcagcatctgatcgaaagtgttggaccatgcggaatccaccgcatcggcggtctggccatatcctgggccggcaaggcttatccacggcgccagccagtgttccgcggcaagcgcatgccatgcttttggcgcttcgtgcgaatcgtggagaaggcggctgtcgttcatactgtctccttggcatcctgcggccggtgggacgctgcctagaaatcatattttcgcaattgccgcgaaaactccgacaatccatcaatcccgctgttttccgcgcgcttgcaccagtcttccaattgaccggacaactgctctgtcgaattggcggatcgctcccacaatgatgccagctcggctctcatggtatagatggtattcagcgccatgctgagcggcagtgtccgctccaaaagttcgcaatccggcagcggctcgcgcgcggcgtggcgcagccatcggcggatggcctcgacgcctgcggcaggttgcagcgcctccaggcgaaagcgaagccggcgcaattccgccgccgctacccgccgcaaggcgtggtcgaatcgggacaataccagataacgatgggcgatcaccgcgctcaacgttccttcgtcgcaatggagtttgcgcggattcaggcgcagaggcgccagcggctggcgcaccatggccaagcccaggcaggcgagcaagcggatgtacagccagccgacatcaaattcccaccagcggatggacaacttggcggacgtggcataggcgtgatgattgttatgcagctcttcgccccctatcagcagccccaatggcaagatgttgcgagaggaatcgttggtggcaaatgagcgatagccccaatagtggccgactccgttgatgacgccggccgcgaaaatgggaatccacagcatctgcgccgcccaaacgctgagaccgacggggccgaacaacagcaggtcgatcaccagcatcaggctgacgcctaagcgggaatggcgggcgtacagccggcgctccagccagtcatccggggtgccgccaccatactgatccagcatcgcctggtcgccggccgcgcggcggtacagctcgctgccctccagcagcaccctccagatgccgagacattgcggactgtgagggtcgtcgagggtatcggtggcggcatggtgcttgcgatgaatggcgacccactcccgggtgatcatgcctgtggtcagccatagccagaaacggaaaaaatggctggccagcggatgcagccgcaaggactggtgcgcctggtggcggtgcagaaagatagtgaccgaagcgatggtggcatgggtgagccccaacatcgccaggccggctccccaccaatgcagatcaagtaaattcagttgcatggcgcctccttcggcaagcggcgctaaaccgcttgtctcttaacgggtgccgcctgttttggccaaatcgatcttcagcggactggcgtgattggccacggcggctgccgcggcatggcggggcgaagcctttttgccgatggcggccagcggattcaggctatccaccatggcgctgggtatcagaatcgtggtgccgcgctccttggtggtttcatagataatgttcatcgcccgcaattgcagcgcggcgggatgttccgcgtagatattcgccgcctcgacaaacttgccggcgatttcagcctcggcggagcccaggatgatccgggcctgtttttcccgctcggcctgcgcctggcgcgacatggcgtcctgcagcgccaccgggatggcgacgtcacggatttccaccgagcgcacggtgatgccccactccgccgttttgtcggcgatcttggcgcaaagcgcttggaccgtgccttgccggtcgctgagcagcacggccagcatcgagctgcctatcatttcacgcaaggaagtctgtgcgattctatcaatcgcctgcgtgtaatcggtgatggccagcgccgccttctgcgcatcatgcacatgccagaagatgatcgcatccacattcaccggcaccgtgtcgcgggtcagcgcctgctcggcattgaaggcggtggtctggattctttcgtctatggtggccaccacgcggtccacgaccgggatgatcagaaacagcccgggtccgttgacgccgcgcagcttgccggcgcgcagcacgacgcatttctgccaggtgttggccatgcgcaaggcttgcgccacgatcgcggcgcatacccaaagcaaaatggccagcggcagatagctggacgcataagccagcaggccagataaaaagaaaacagcgacaatgaacgaggtgatgggattcatggcgggactccttgccgaggatttgagcgccgggctggctatgctttagcatcggcgcgtttgccgcgcgccatctgtacgctgtcatacatagggatgaatattgaggccttgtgtcatttcaagcacatcgctgctcctgggtgcagaacgcaatggatagggcgatgacggcctgccccaacccgcgcgcttgtgactcgctttcggcaatgcggtttgctttcaaatggcttgaagactggagaagacatgagcggcaatgatgatcccaggcgcaatggcgtgctcgccgacctgccagagctcgagtggcaaaggctggccccgcagctggagccggtggaaatgccattgggcaaggtgctgtatgagcccggctgcacgctaagccacatttacttcccgaccactgccattgtctcgctgctctacgtgatggaggatggcgcctctgcggaaatcgccgtggtcggccatgaaggcattgtcggcatcgccttgttcatgggcggagagacgacgccgagccgcgcggtggtgcaaagcgccggcacgggctaccggttgaaggcccagatcttgaaggacgaattcaatcgagcgggggcgatgatgcacctgctgctgcgctatacccaggcgctgatcacccagatggggcaaaccgccgtatgcaatcgccaccattcgctggatcagcagttatgccgctggctgttgctgagcctggatcggctgcccggcaatgagctggtcatgacgcaggagctgatcgccaatatgctgggcgttcgccgcgagggcgtcaccgaggccgcgctcaagctgcagaaagccggcttgatccactatgcgcgcggccatatcaccattgtggatagagacggactggagcgacgcacctgcgaatgctacgacgtcgtgcgaaaagagtatcaacgcttgttgaccgtgccgctggcgcggcgttgagtgcgcggcatcgcgccgccgcgacaaggcggacacgctcaccgcgcccccagcaactgccgcaacacatagggcagaatgccgccatggcggtagtactccacctccaccggggtgtcgatgcgcagcagcaacgacagttgccgggtctgcccatccggactccgcgccgtcagcgtcaccgcttgccgcggctggatgccctgttccagcccgctcaagtcgaacacttcatcgcctttcaagccggccgcgctgtcggaaccggtgaattgcagcggcaacacgcccatgcccaccaggttggagcggtggatgcgctcgaagctgcgggcgatgaccgctttcactcccagtaatcgagtgcccttggctgcccagtcgcggctggagccggtgccgtactcctcgccggcgaagatcagtgttggcgtgccggtccgctggtattccatcgccgcatcgtagaggaagcgctgcgcgccatccggctggctcagcgtcaacccgccctccaccggcttgccgtcggcgtccagcggcagcatcagattgcggatgcgcacattggcgaaggtgccgcgcatcatcacttcgtggtggccgcggcgcgagccgtagctgttgaattccaagggcgcgatgccccgttgttgcaggtattgcccggccggggagcttgccttgatcgaaccggccggactgatatggtcggtggtgaccgaatcgccgaagatggccagcgcccgcgcgccctgcacctggggcaccgccgccggctgcagggcaaaatcctggaagaacggcggctcggcgatatagctggaatcctcccagccatacacctgcccggtcggcgcggcgatgccgctccacagcggattgctgtcgacaaaatcctggtacaggcggcgataggtggccggatcggtcgcctgcgccagcgcggcggccacttcctggccgctgggccagatttcgcgcagccacaccggccggccggcgctgtccacgcccaggggctcgctgtccaggtcgatgtccacccggccggccagcgcgaacgccaccaccagcggcgggctcatcaggaaattggccttgatagccggatggatgcgcgcctcgaaattgcggttgccggacagcacggcggcgcagatcaggtccttggcggcgatttccgcctccagcgccggctccagcggcccggagttgccgatgcaggtggtgcagccgtaagccaccacccggaaacccagctgctgcaaggacggcagcaggccggccttgtccagatagtcggtgaccacccgcgagcccggcgccagcgaggtcttgatgcgcggcgccaccttcaggccgcgcgcggcggccttttgcgccagtaggccggccgccagcatcacgccgggattggaggtgttggtgcaggaggtgatggcggcgatcagcaccgcgccatgtcccagcgcgccatccgacgccggcgcggcgccggccttgccgtaaccgccgctggacgccggctgcgccagcagctcatggaagcgggacttcagcgccggcagcgcgatgcggtcttgcggccgtttcgggcctgccacgctgggcacaatgccggccagatccaattccagcgtctggctgtagtcgatcgcgccggcctgcggcatgccgaacaggccctgcgcctgaaaatagcggcggaaggcatcgacctcctcctcgctgcggccggtggcggcgagataggccgccgcttgttcgtccggcggaaagaaacccatggtggcgccgtattccggcgccatattggccagcgtggcgcggtccggcagcgtcaggctggcggcgcccgcgccgaagaattcgacgaacttgcccaccacctgcgcctggcgcagcctctccgtcacagccagcaccagatcggtggcggtaacgccctcgcgcagcctgccggtcagatgcactcccaccacgtccggcgtcagcagatagaccggctgccccagcatgccagcctcggcctcgatgccgcccacgccccagccgaccacgcccagcgcgttgatcatggtggtatgcgaatcggtgcccaccagcgtatccgggtaataaacctcatccttgcgcagcacgccgcgcgccagatattccagattcacctgatgcacgatgccgatgcccggcggcaccacccggaaagtctcgaacgcctgcatcccccatttgatgaagcggtagcgttcggcattgcggcggaactccagctgcatgttcagatccagcgcattgccttcgcgatagtgatcgacctgcaccgaatggtccaccaccaggtccaccggcaccaggggttcgatcagcttggccggcttgccgaagcgttccgccacgccgcgcatcgccgccagatcgcacagcagcggcacgccggtgaagtcctgcagcacaatgcgcgccaccacgaaggggatctcctcgctgcgcgccgcccgcggctgccagctggccagttgccgcacatgctcctcggtgatgcgccgcccatccagattgcgcagcagcgactcgagcacgatgcgcagcgacaccggcaggcggctgacatcgccgacgcccagttcggccaatgccggcaaggagtggaaacaggcctgccggccggaggccagcgggaacttgcgtaaactgtcttcagcgctaaggggcatgaccggctcctgtggaaatggggaacagcgacgatgcggatgggattcgcttggactatggctgatggacggagttcttcgccctcgcctgcgcagcgccttggccgtaaggatgcctgccgggacaagaggctttcggcaaggcgcgcgcccatgaaaaacgccgcccacccttgcgggcggacggcgcgatcaccaaggcaatcggttcggctatcaggctttgctggcggccagttcctgatattcttcgatctggtcgaagttcaggtactggtacacttcagcgcccttctcgttgatgatgccgatattggcctgatattcctccaccgtcgggatcttgcccagcttggagcagatcgccgccagttcggccgagcccaggaacacgttggagttcttgcccagacggttcgggaagttgcgggtggaagtggacatcacggtggcgccttcgcgcacctgcgcctggttgcccatgcacagcgagcagcctggcatttccatccgggcgccggcgcggcccagcacgccgtagtggccttcttcggtcagttgcttggcgtccatcttggtcggcggagccacccacagcttcaccgggatgtcggccttgccttccagcagcttggaggcggcgcggaagtggccgatattggtcatgcacgagccgatgaacacttcgtcgatcttggtgccggccacttcggacatgaacttcacgtcgtccgggtcgttcgggcaggcgacgatgggctctttcacgtcggccaggtcgatctcgatcacggccgcgtattcggcgtcggcgtcagccttcagcagctggcccttggcgatccactcttccatcgccttgatgcggcgctccagcgtgcgcgcgtcctggtagccatcggcgatcatcgctttcatcaaggtgatgttggagcgcatgtactcgacgataggctctttgttcaggtgcacggcgcagccggcggcggagcgctcggcggaagcgtcggtcagctcgaacgcttgctcgaccttcagatccggcaggccttcgatttccaggatgcggccggagaagatgttcttcttgccggccttggccacggtcagcaggccctgcttgatcgcgtacagcggaatggcgttgaccaggtcgcgcagggtgacgcccggctgcagcttgcccttgaagcgcaccagcaccgattccggcatgtccagcggcatcacgccggtggcggcggcgaaggccaccaggccggagccggccgggaaggaaatgccgatcgggaagcgggtgtggctgtcgccgccggtgccgacggtgtccggcagcagcaggcggttcagccagctgtggatcacgccgtcgcccgggcgcagcgatacgccgccgcgggtggagatgaaggacggcagctccttgtgcatcttgacgtccaccggcttggggtaagcggcggtgtggcagaacgactgcatcaccaggtcggcggagaagcccaggcaggccaggtccttcagctcgtcgcgggtcatcgggccggtggtgtcctgcgagccgacggtggtcatcttcggttcgcagtaggtgcccggacgcacgcccttgccttccggcaggccacaggcgcggccgaccattttctggcccagcgtgaagcccttgccggaatcaaccggcgacttgggcaggcggaaggcggtggaagccggcaggtccagcgcttcgcgcgccttggaggtcaggccgcgaccgatgatcaggttgatgcggccgccggcgcgcacttcatccaggatcacttcggatttcagcttgaactcggcgacggtcgcgccgttcttctcgatcttgccgctgtacgggtagatgtcgatcacatcgcccatttccagcttggacacatccacttcaatgggcagcgagccggagtcttcctgggtgttgaagaagatcggcgcgatcttgccgcccagggtgacgccgccgaagcgcttgttcggcacgtaagggatgtcctggccggtggcccacaccaccgagttggtggcggatttgcgcgaggagccggtgccgaccacgtcgccgacgtaagccaccaagttgcccttggctttcaggtcgtcgatgaactgcatcgggccgcgcttgccctcttcttccggcacgaacttggcgtccgggcgcgggtttttcagcatggccaggtagtgcagcgggatgtccggacgactccaggcgtccggcgccggcgacaggtcgtcggtattggtttcgcccggcaccttgaatacggtgactgtgatcttctcggccacttccggacggctggtgaaccattcggcgttggcccaggactcaaccacttccttggccacggcattgcccttgtccattttttccttcacgtcgtggaaggagtcgaacatcagcagggttttcttcaggccggcggcggcgatcttggcgacggcggcgtcgtccagcaggtcgatcagcggcttgatgttgtagccgcccagcatggtgccgagcagttcggtggccagttcgcgcgaaaccagcggcgactgcacgctgccttcggcgacggcagccaggaaggatgccttgaccttggcagcgtcgtccacgcccggcggcacgcggtgggtaatcaggtcgaccagggtgctttcttcgcctttgggcggatttttcagcagttcgaccagttcttcaacctgcttcgcggacagcggcaggggcggaatgcccagcgctgcgcgctcggcaacgtgctgacgataagcttgtagcatgacttgggaccttcttggcttggttgttggcaagctcgccgccgcaagccatgcggctggcaagcttcacccggcgattttgcaccattcctcgcggatggcgtagtgaatgatgctctttgtagtgactgaagattacgcgtttagacgattgcatacaaacgagtaatggcaacatggattgtgagttaaaatcacagcatgagcacataccccccattgaactccctgcggatttttgaagccgcagcccgactggagagcttttccgccgctgccggagagctgttcgtcacccatggcgctgtgagcaaacagataaagcagctggaggactggctggggattttgctgttcgagcgcagcggcggccgcgtcaagctgaccgacgccggctggcgctacctggtgcaggtgcaagatggcctggacctgatcgccaacgccacttcgcagctgctgcagcccaataatcagcgccggctgagcatcaactccacccccactttcgccagctactggctgctgcccaggctgggcggatttcgcgcccgctttcccgacctggagctgcacctggccacatcggaccgcgacatcagccgactggacgcgccgttcgatctggccatccgccgcggcccgggagactggccgggccatatcgccaaaccctttttgaaagagtgggaactgccgctgtgcagcccggcgctgttggcgcgcataccgctgcacagcccggccgaccttaccgcccacaccctgctgcatgccgatacccggcccaccgcctggccgcgctggttgacgctggccggcgtgccggagttgaagccggccagcagcatgcatttcgacaagttctcattggctttgcaggcggctaccgatgggctgggcgtggtgctggggccgatgccgatggggcaggcgcagatagacgccggctttctggtatcgcctttgccagagccggtggtgaccgtacgcgattattgctgggtggtgccgcgcatggcggcggaagaccccaccgtgtcggcgttttgccgctggctggaaagcgaggccggcgcctagcggaccggcccgggcggcacgcctatcagcctgacgtccatgggcgcggcatcgcgcggcagccacttgttgtagatgcgcttgtaggcgccgtccttcttgatggcggtaaagccgtcctgccagcgtttgacttcgtcggccggagtgccgcgggaaaacgccaggtagagctcaagcgattccagcacgcgcaccaactccaccgagtccgacggctgatggatgtccttcaataccgaagacaccacgaagccgccctccacccacatatcgtagcggcccagcagcaacttctgcgtcgtcacctgcggcgtcggcgccaagtcaacttccacaaagccagccgcggatgcggcatcggcgaagatgctgccgcgataggcgccgaccgggcgctggtaaatgccggctcccagcgccagcagtttcgccgcttcgcccttgcgcgccagcaaaaccgtttgcgacaccgctatcggccccagcagcgacatctgcctctcccgcgcttcgttgcggccgacggtgaacagcatcacgccaggattagtcagcagttccttgtagccgcgcgcccagggcaccacttcgatctggctgttgtcatgaatgcgggattggatttcccgcaccacctccaccgccatgccgtcagccacgccattgcgctggaaggtgatgggcggccagtcttcggtataaatggtaagcgcgggagcgggggcggaccaggcggccaagctgaacagcagcagcgcgatagtgcgggagagcatggcggctcctacgtaaaactactagcttcttgatagcccttcccaagcccggccgccgacttattcgctataatgccgcgttgtgcccggcagcgcgccggcattaccatttgcgcacccacccattcccgaaggaacgacatgagccgcatcaccctctcccgctttctgatcgaacagcaacgcaaggccggcacgctgccgccggaattgcgcctgctgatcgaaaccgttggccgcgcctgcaaggcgatcagctattcggtcaacaagggcgcgctggccggggtgctgggcgaagccggcaccggcaatgtgcagggcgaggcgcagaagaagctggacgtgatcgccaacgactttctgctggacgccaatgaatggggcggcagcctggcggcgatggcttccgaagagatggaactgccctaccacatccccggcgaatacccgaaaggcgaatacctgctgatgttcgatccgctggacggctcgtccaatatcgacgtcaacatctcggtaggcaccatcttctccatcctgcgctgcccggaaggcgtgacgcaacctagcgaggccgattttctgcagcccggcacccgccaggtggccgccggctacaccgtgtacggcccgcaaaccatgctggtgctgactttcggcagcggcgtccacggtttcacgctggaccgcgagcacggctccttcgtgctgacccacccggacatgcaggtgccggagcgcaccggcgaattcgccatcaacatgtccaatatgcgtcactgggaagcgccggtgcgccgttatgtggacgaactgctggctggcagcaccggcccgcgcggccgcgatttcaatatgcgctgggtagcgtcgatggtggcggaagtgcaccgcatcatcacccgcggcggcatcttcatgtatccgaaggatgcgcgcgacccgggcaaggccggcaaactgcgtctgatgtacgaaggcaacccgatggccttcgtcatcgaacaggccggcggcgcggccaccaatggcctgcagcgcatcatggacatccagccgcagaaactgcacgagcgcgtggcggtgttcctgggctccaaggaagaagtggaactggtgagccgctaccatctggagcaaaagtaaatccggagtgcccgctccaagccaaagcccgccatccggcgggctttgtttttatcatgccgcaatcacgcctgcgcgggcttgagcgccgatgccagcatgcgccagccggcataagcgaacgacacggacaacgcgccatcgaacaagcggctcacccgcaaaaagccctcccgcacccgcggcaacgaaaacaccgccgcgtagccgccgaataccagcagccctatcgcccagtacccggccaccatccacagcccatcccgcagcgagccgccggccggcatagccagcgcgacaatggataaccagacgaaaatcgccttgggattggtcaggtgcatggcggcgccgcgcagaaacatcttccgtccagcttccccgcccggcatacccgccggcacgcgcagaccggcgatggcggtgcggccggagcgatacgccagccagaacaggtaaagcccgccggccattttgatcgccaacagggccatcgcgctgtcggccagcaccgccgacaagcccagagcggcaaggcagccccagaacagcgagccgcaaacgacgccaagcgcaagcatcagcgccgggcgcggccccgcgtgcatggcggcggacatgatggccagattgctgggcccggggctggccgtgcccagcagataagacgaataggccagcagcagatcgactgggacggcatgcggagaaatcatggcgggctccaattgggctagacccctcattatgccaacatccttacatggctgcgcattcggacaagagccaccgccgggcatccggccaaccgctcggccaggcgcttggcaatgagagcgctggccaactggtgtagaatgggggaataccaatcattagcagccggacgaggcttgatggtttggttgggcaattctcgaatttgcccggccagcccccctgccaaaccctgccacccactgaaaacaacaggcattatcaaaaaatggctattcaactgaaagacgcccaggacatcgaaaaaatgcggatcgccggccgcctggcctccgaggttctggacttcatcactccgcacatccagcccggcatcaccaccgaagcgatagacaagctgtgccatgactacatggtgcgcgagcaaggcactatcccggcgccgctgaattacgcgccggatggccacatcccctaccccaagtccatctgcacctcggtcaaccacgtcatctgccacggcatccccaacgacaagccgctgaagaacggcgacatcgtcaacctggacatcaccgtcatcaaagatggctaccacggcgataccagccggatgttctacgtcggcgaagtcagcccgcacgcacgccgtctgtgcaagatcacttacgaatgcatgtggaaaggcatcgaaaaggtcaagccgggcgtcaagctgggcgacatcggctacgcgatccagcagcacgccgaagccgccggctacagcgtggtgcaggaattctgcggccacggcatcggcaagaaattccacgaggagccgcagatcctgcactacggccgcccgggcaccgggctggaaatccaggccggcatgatcttcaccatcgagccgatgatcaaccagggcaaacgccacctgcgcatgctggccgacggctggaccgtggtcaccaaggaccgcagcctgtccgcgcagtgggaacacacggtgctggttaccgaaaccggctatgaaatcctgacccagtccgcgggcacgccggaaaagccttcgttcaaataagcccggcgttgtcaaatgcctgccgtccgacccgcgcgccgcgcgggttttttattggcgcgataaccgcgacggcgacagaattgttgcgatttttaaattgccattgtgtcggcaagccattgtttctaaactgaaccaatagtattgtcttgagcagtccgcctgcgggagaagcaccatgtcactgaccatcaatagcaatctggcctcgctggccggacagacccaactgagcaagacccagaagtccatccagcaatcactggcggaactgggatctggccaggcctcggtcaatgcggccaatcaggcgatctcgcagcaactgcaggctcagatcaacggcaacaatcaagcgttgaacaataccaacgacggcgtttccctggtgcaaaccgcggattcggcccttgggcaattgcaaagcaacacccagcagatccagaccctggcgatccaggccggcgacggcgccctcagcggcagcaaccgccaagcgctgcagcagcaggtagaccaattgacccaggccaactcgcagatcgtgcagagcgcccagtataacggcaccccgctgctgaccggcggcaacgccaccactttccaggtggggccgaacggcaccagttccaaccagctcaccgtgcccggcatcaatctgtcggcggcgccggcgtccggcggcctcaacagctacaacgccaacctggcggcgaccaacaccatagacatcaccacccaggccaacgcgctgacagcccagcaatccgcccagaacgacctgaatgccatcggcgcgcagcggaccacgctgggagcggtcaacaatagtttcaattcggtggtggacaatctgcagacttccaacatcagcacgcaggccgccaacagccggatcagcgatgcggattacgccgccgccagcgcgcagctggcttcgcagcagatactaggccagtcggcggccctggcgcagcggcaggccaacatcgcgccgcaagccgccttgtcactgctagggtgaggcaatattcggaaaagttccacgggatgaggggtaaataattgcgggatcggccttgttggcgcagctttgaatcctttatgatcaagatatgaatccatccaggatttgtccatcgggcacccgtcgcggtgccctttgtccatctgaaggagtctcatatgtcgatcaccccagccatcacggtttcctctctcgattacgagcgcctggccgccttgctggaaacctgcgaacaggggcaccccgttgccggacgcctggaagcggaactggagcgtgccgaggtggtggagcctgaagccatgcccgcaaacgtcattaccatgaacagccgcgcccgcatccgcctgggcgacggccaggaaaagctgctcaccctggtgtatccgcgcgaggcggatagcgaacaaggccggatttcggtgctcgcgccgatcggggcggcgctgcttggcctgtccatcggccaggacatgcaatggccgactccctccggcactacccggctgactgttctggaaatcgtttaccagccggaagctgccggcgaataccaccgctaagcgttagccgcggccgggatcgtcctgctaggaattgtcggcgtagcgcagcgcgatggcgtggaactcgtcggcgatctgcaagaaggccttcaccatctccgggtcgaaatgccggccgctgccctcgcgtatcatgtccaccgcctggctgtgaggaaacggcggcttgtaggttctgcgcgatatcaacgcgtcgtagacatccgccagcgccatcaatcgcgcggaaaccggtatcgcgtcgccggccagcccttccggatacccgctgccgtcccacttttcctgatggctgtgggcgatctccctggccagccgcaggaaattgctgggcgtatccagcattttttccgcggccgcgatggtatcccggcccagcgtggtgtgggttttcatgatttcgaactcctgcggcgttagcgggccgggcttgagcaggatgtggtccgggataccaaccttgccaatgtcatgcaatggcgccgacttgtacaacatcatgatggtttcgtcgtccagtcccttgcggtatttggggtggttgcgcagctccatcgccagcgcgcggacgtagttctgggttcggcgcaggtggttgccggtttcgtgatcccttgtctccgccagcgaggccagcgccatgatggtgacgtcctggatcacctgcacttcgcgggtgcgccgctccacctcgctttgcagaaaggccgccttgtcttcgagaaaatccgaagcggccttgagacggagatgagtggtgacgcgcgccatgacgataggcggcgaaatgggcttgatgatgtagtcgaccgcgccggcatcgaaccccgcttgctcgtcttcgttctcgctcatcgccgtcaggaaaatcaccgggattcccatggtgcgcggatcgcttttcagccggcggcacacttccagcccgccgatgcccggcatcatcacatccagcagcaccagatcgggcaggacatcgccggcgacgatctgcagcgcccgctcgccgctgttggcgatctgggtacggtaatgatccttcagcaagccataaagctgggtgaggttctccggcgtgtcgtccacgatcaggacagtctggcgcctcagttctgacgtgttcatgatgcatcctcaggaagggcgatgccgtgctgtgttgccgccgtgcgcaatgatgtcaaggcggtggcgaagtcgaaattcgtcaatgccttttcgaatgcggcgtagtctccgccggggaaggtttccctcacttcggcggcgtgcgacaggaaataccccaaggcttccccgtcgctggcagccaacagacgggacagctcaagcagcaatttacctccctgcgccacaccctgatcgggagccggcgccagcgcgtcgagcccgcccttaagcgcagccaccgcgcgctccatctgccgcatcagcgtcgccacgccttctttgcattcggttcgggaacggatcgcctgctccagcttcgccgcggtttcgggcaagccggccagccctatgctgccggtggtgcctttcagcgtgtgggcgatgcgctcggccaacggatagtcgccgtcctccaatgcctcgtcaagccgcgcggcggcgcccgcctcttcagcgacgaactgccgcagcaggtgcaggtacagctcccgattgcccgcgacgcgccgcagtcctgcggcgctgtcgaggccttcgataagcggaatgacccgttcctcttggtttggttcctgctttcgcgcgggaggactctctaccggccgggtccagcgcttcagcgtggataacatcagatggggatcgataggtttggcgatatggtcgaccatgccagcgctcaggcacccttcccgctcttccaccagcgcgtcggcggtcatcgcgatgatgggcagcgcggcgaagcgggcgtccgcgcgtatccgccgcgtcgcctcgatcccgtccatcaccggcatctgcacgtccatcaataccgcgtcgaatccttccgggccataggtctccagcttgtccagcgccagctggccgttaccggcgaccgtaacagtggcgcccgcgccctccagcagctccaccgcgatttgctggttgatggcgttatcttccgccagcagcaggtgcaggccgttcagactggtgaaatcatcgtttttccgcggcgactccgtccgcgcgccgccgccgaacacctccaccagcacgtcgaacaacgacgactggctgaccggcttcaccaggaaggcatcgctgcccgccgctttggcatcggcgcgcacatcatcgcggccgaaggcggtcaccaggatgatgtgcgcggtgcgggtgatttcgcggatgcgtctgatcgtttcgatgccatccatctccggcatcatccagtcgatgaaaacggcgtcgtagggttggttgagcgccgcctggcgcaccagcggaatggcctcgctgcccagcgtgcaggtgcttaccacgaaatccagcgcgcgcagctgttcagacaggatgtcgcgcgcggtggcgttgtcgtccaccaccaggatgcgcatgcccttgatattgtggggcaaggaatcgaggcgagcgtcgacagcgcgcgacaagccgagccaggagctgaagatgaaggagctaccccagtcgggcgcagactccacctgtatcgtgccgcccatcagctccaccagccgcctggagatggctaggcccaatccggtgccgccgaagcggcgggtggtggagccatccgcctggctgaaggcctggaacagcttggctacctgctcttctgtcatgccgatgccggtatcgtgcacgcagaagcgcaattgaaccttgtcgccgatgcggtcggccagggtgatgatgatggccacctggcctttctcggtgaacttgatcgcgttgttgaccagattggtcagaatctgccccagccgcaacgcgtcgcccaccaacccttgcggcacttcctttcccatctcgaaaagcagctccaggtttttgtcggcggctttttgagcaaccagcgaggagatgctctccagcacgtcgtccagccagaacggctcagactccaggtctagcttgccggcctccaccttggaaaagtccaggatgtcgttgatgatgcccagcagcgaggtgccggcgttgtggattttgccgacataattgcgctgctgttcggtcagctcggttttcagcgccagataggacatgccgatgatggcgttcatcggcgtgcggatttcatggctcatattggccaggaacatcgatttggcttgggttgcggcttcggccgcctgtttggcgtcgcgcaattccgccgacgaagcggccagcttggcgtaaagcttgccgttttccagcaacaagacgatcagcacgaagctggcggccatgaggccatagacgcggccgacatagaagcccagatcgaaacggccggcattgagcatggccgacaaggcgacatcgcacagccaggcgaacagcaccaccatcagccacaggtctagcaaactgcgcggacgcctgaggccgaccgccaccagcgccagcaggctcatcccccagacgctggacaccactacccacagcagcgggctataacggttgccttgcatgatcaccggcagaaagccgtggccggatgtggctaacgccaggaaggtgaggaccagcaccaatgtcagcagaaccgatgccaggatggagcgccccactctggctggcgacggttccagcagcggcctgtccgccatccaggcataaaccaccactaccgcggggaagccgccatgccagaacatatacatccaggccgtggtctgcgcgcccgagcccagcagcccgtgttcggcgaacaagccgggaaaggtcagcgagtgcgccatcgccatcagcgcggtatacagataacctatcgccaacagttgcagcgagcgcagcctcaagatggcaaactggccgaacagtagcaccgcggtgaccagatcgttgatggccagcgccgactggtataccggaatgaaggcccacaccttggccagcggaattttggcgaacggcaccgtaatgacgaacaccagcgcggagatcagcatggcgctgtaggccaaagcgctctggccgcgcgtaggcggcagggttgagagaaattccggactctggaggttcgccgagtctgattgctgcataagcatcactctccgcggaagcatgtcgcaccattacccagcgtagagaacgatcagggtcggccgtgtcattgtcgtatgatatccagcataggtggaaaaccggattgccgcatctttcccgacttgctgacgggatgaaaaggcgggcgccattcgcgcccgcctttggatgcttgccgcgttgagcgcctatttcagccagccgctatccctggccttctccagccggccttccaggtattcccacatcgccggacagccctggcgcaccggcgggccgatccggctgaccacctgctcgtggcggatgccgttttcccgccagctctggcctttgttggccaggttcagcaataccggcatcgcgcggtcggcggcgtgggcgaaacgcgcttcggcgctctccccggcttcgaactcctgccacaaggcgaggaagcgcccgccctgctcgggcggcagcatgccgaaaatgcgggtgacgcaggccagttcctgcgccttgcgctcctcccagccgccttcggcgtagacgatggtgtcgccggtttcgatctcgccgatatcgtgcaccagcagcatcgccaccaccttggcgatgtccaccggctcggcggcgtaaggctgcaaggatgccgccagcagggcgatctgccagctatgctcggccgagttttcataacggtcgctgttcagcacccgggtcttgcgcgtcacttgcttcagcttgtcgatttccagcacgaaatccacgatgtcttgcattggttttctttctgtcgatacaaaaaaagcagaccgcggtctgcttgcgccggcgctcaccagcaccgttgaatcatctgggccaactgcaccaagcggccgtggaaaaaatggcccgcgccggggaacaccagcaccggcaggctttgcggccgcgcccattccatcaccgccgccagcggaatcacttcgtcttcttcgccgtggatcaccagcgtgtcggcaggcacctccggcgtcggaatcgggtatttgcccaccgccacgcccatcagcagcagcttgtcggcgtcgatgcgggcgcgggtacgggcggcgacgaagccgccgaaagaaaaaccggccaatgccagcggcaagcccggatattgcgatttggcatggtcgaccaccgcgatggcgtcgtccacctcgccgttgccgtaatcgtgttcgccttcgctgtcgccgacgccgcgcagattggggcaatagcagacatagcccagttgcgacagggccttggccgcagtctgcaccaccttgttggtgtgcgtgccgccttgcagcggattggggtggcagatcaccgcgacgccggtcgcttcgccctgggcatccaccacgatggtgtccagcatgccggccgggccggcgatgccgaccttgttcatcgccttcagcatcagatcttcagcctttccaccacgcggccgttgaccatgtgctcgttgatgatctcgtcgatgtcgtccttgtcgacgaaggtgtaccaggtttcctccgggtagaccaccagcaccgggccctcgttgcagcggtccaggcagccggccttgttgacgcggatcttgcccttgccggacaggcccttggccttgatctgttccttcatgtacgcgtgcagttcgctggcgcccaggttgttgcagcagccctcgccgttggcgcgctggttgcagcagacgaatacgtgcttgtcgaaatagctcatcggaatctcttggttgtgagggtcaggagtcgctgtcggcccagccgctgacgccgacggtggcggcgttgtcgaacttggcgtatttgccgacgaaggccagtcgcaccgccccggtcgggccgttacggtgtttgccgatgatggcttcggccaagcccttcacttcctggttgtccggactgtaatactcttcgcggtacatgaacacgatcaagtcggcgtcctgctcgatggcgccggattctcgcaagtccgacatcatcggccgcttgttgggacgctgctccaccgcccgcgacagctgcgacagcgcgatcaccggtacctgcagctctttggccagacccttcaggccgcgcgagatttcgcccagttctgcggtacggttgtcgccgcggccggagccggacatcagttgcaggtagtcgatcacgatcaggccgagcttgccgccgtgctggcgcgccaggcgccgcgcgcgggcgcgcacttccagcgcggtcagcgccggggtttcgtcgatgtacatcggcgcttccgacagcttgcctatcgcgtaagtgagcttctgccagtcgtcgtcgcctagcttgccggtgcgcagcgtgtgctggtccagccggcccaccgaccccagcatccgcatcaccagctgcgcgccgcccatttccatcgagaacaccgccaccggcaagtgggtttccacggccacgtgctcggcgatgttcatcgagaaggcggttttacccatggacggccggccggcgacgatgatcaggtcgcccggctgcaggccggaggttttggcgtccaggtcgacaaagccggtggggatgccggtcacttcgtccgggttgtcgcggctgtacagcatgtcgatccgctccaccacttccttcagcaggcccggcatttccaggaagccctgtttggacttggcggtggattcggcgatctggaacactttgccttcggcttcgtccagcaactgcgaggcgtcgcggcccatgggcgaatatgcggcctcggcgatttcggtgcccaccagcgccagctggcgcatcaccgagcgttcacggacgatttccgcataacggcggatattggcggccgacggcgtgttttgcgccagcgtggcgagataggccaagccgccgatattgccgagctggtcgttcttgtccagcgattccgccaccgtcaccacgtcggccgggcgccccagctccaccagtttggcgacatgcttgtagatcagccggtggtcgtggcggtagaagtcggcctcggacaccacgtcggcgatcttgtcccaggcgctgttgtccagcagcaagccgccgatgaccgactgttcggcctcgatcgaatgcggcggcgtgcggatggcggccatctcgccatcaaaattctcgtactgttctgtcatgtatatccggggtgctcagcgccggatggcgcccaaaaggcaaaagacgattctaacccgaaacccggcccggctcacgcgctttggccgggctgcggcctgtcagcagttcattccggccacgtagccggacgaccaggcccactggaaattgtagccgcccagccagccggtgacgtccaccacctcgccgatgaaaaacaggccgggcacatcggccgccatcatggtcttggacgacagggccttggtggaaacgccgcccagcgtgacttcggccttcttgtagccctgggtgccgttgggcttcacccgccagcggtgcaagctctccgccagctgtttgcgctgcttaagccccaggtccttcagccgcttgttgaagccctcgcggtccagccaggcctcggcgaagcgcttgggccaatggaattcgcccagcgcgttggagatcagctgctcgctgcccgccctttcctccagccaggcttctgcatcggcgtccggcagcagattgagcgtcagctccatgccgggctgccagtaagacgatatctgcaggatggccgggccggacacgcccttgtgggtgaacagcacgttctcgcggaacttgcccttgccggcgcgcgcctcgacgtccagcgacacccccgccagcggcgaaaacgtgtcggcgtcctccacgtggaaggtcagcggcaccagcgccggcgtcagcggcgtcaacggcaagccgaactgctcggccagctgatagccgaaaggcgtcgcgcctatctgcgggatggacagcccgccggtggccaccaccagagattcggcgcgcaactcgcccatcgaggtttgcagcgcgtagcccgactcgacgcgcgccacctgcgagatagtggtctccatccgccgctccacgccggcctgccggcattcctcgtccagcatggctataatccgctcgctgccgtcgtcgcaaaacaactggcccagcttcttttcgtgatacgcgatgccatggcgctccaccatggcgatgaaatcctgcggcgtgtattgcgctagcgccgagcggcagaaatgcgggttgtccgacaagtagcagtcgaacttggcgtaaaggttggtgaagttgcaccgcccgccgccggagatgcggattttttccgccagtttggcggcatggtccagcaacagcaccttgcggccgcgctggccggcggtggcggcgcacatcaaaccggccgcgccggcgccgatgacaatcacatcaaattgcaaatttctatccttaccatttcggtcaactattggcctgtccgcgcatcttccagtaaactgcgcgtaaagcatccgcttatgcggcttactttctcaaccaggagagcataatggaacacaaactgcctgaactgccgtacgcgctggacgccctggcgccgcacatttccaaggaaaccctggaattccactacggcaagcatcaccagacctacatcaccaacctgaacaacctgatcaagggcaccgagttcgagaacgcctccctggaagagatcgtgaagaaatcctccggcggcatcttcaacaacgccgctcaggtttggaaccacaccttctactggttcggtctggcgccgaacgcgggcggcgaaccgaccggcgcgctggccgacgccatcaaggccaagtggggttcgttcgaggaattcaagaaggccttcacccagaccgccgtcggcaccttcggttccggctgggcctggctggtgaagaacagcgacggcagcctggacctggtatccaccagcaacgccgccactccgctgactaccgacaagaagccgctcttgacctgtgacgtgtgggaacacgcgtattatatcgattaccgcaacagccgcccgaactatctggacagcttctggaagctggtgaactgggacttcgcgtccaagaacttcgccgcctgattccggcgcgcaagaccaaaggggcttcggccccttttttattgtcggcggccaagcgggcggttcagcgctcggccatccactgcaggaacatttccgccgacagcggacggctgctgtaatacccctgcgccacatcgcaacccagcgccgacagctgccgccagtcttcttcgttctccaccccttccgccaccgacgacagccgcagacgctggcacatggcgatggccgcggtgagaatggccagcttcttcggactgctggatgcgtcgtggacgaattcgcggtcgattttcagttcggtgaacgggctgcgcgacagctgcttcatcgatgagtacccggtgccgtagtcgtccatcgccaggccgaagccattcagccgcaagcgcgccagcgtgcccagcgaggccgccaggttggacatcagcgaggtttccgtcacctccaccacgatggcatggcaggtcagtccgcatgactgcacgatgcaggtcatttcatccaccagattggcgtcgttgagcagcggaaccggcagattgatcgacgcgtgcagatccggctgcacggcgagaaaacggttcaactccaggcaaacctggcgcaagaactggtaaaagaagcgcagcgccagcggcccctgttccaggtgatggacgaacaccgccggctgcagcacgccgaactgcgggtgctcccagcgcactagcgcctccatcccgaacagacgtccgtcgcctatcgagatcttgggctggaagtacggcaccagttgccccaggcccagcgccagcgccacctcttcctggctgagcttgagattgctgatgacggcgccggacaggtgccagtccgggtcgcagccgtccagcacccgccgcacttccgccaggctcagcggcttgggaaacaccgccagcaggtccagctcggacgcgtccaccaccccctgcaccgtatccagcacgtcgcgcggcacgccgctcatcaccgcgacgaacttcaccttgcccttgcaggtcttggcgatgctctccagcagcttgacgccgtccatgccgggcatgttgaggtcagtcaccaccaggtccaccgacgccagcacagccaattgtcccagcgcgtccagtccgttctccgcctcgtgcaccacggcaaaaccaaactcgcgcaacagtccggctgccaccatgcgctggctgggggagtcgtccaccaccatcgcgctgcggcccagccatttttccagatgcgtcatggttcaacccctgattccggccaaggtgtgggtaatgcgctccagcgacatcacctcgtccaccccgccatggctgatggcctcgttaggcatgccgaacaccacgcaggactcctcgtcctgcgccagcgtccgcgcgcccgcgtcgtgcatctcccgcatgccgcgggcgccgtcgtcgcccatgccggtcatgatcactcccaccgcatttttgccggcattcaccgccaccgagcggaacaacacatccaccgacggccggtggcgcgacaccagcgggccgtccttgacctccgccatgtattgcgcgccgctgcgcttgatcagcagatgcttgccgccgggggcgatcagcgccacgccggaaatcagccggtcgccgcttctcgcctccctcacctccaccttgcatagccggttgaggcgatcggcgaaagacgcggtgaacttctcaggcatgtgctgcaccaccgccacgccggggcaggtggcgggcagcctgggcagcagatattccagcgcctgggtgccgccggtggaggtgccgatggcgatgatcttctcggtggcgtggtatttctccaggcccgatggcgcgtccagcaccacatcggcggtaagcttgggcgccgggccttgctcgccgcccctgggattggccgcgctgctggcgatgcgcttgaacacgcccatccgcgcgccggcggcgtcgcgcacttcctggatcagttccttggccgcctcctgcagaaaggatttcaaattgatggtgggcttggtgatgatggccaccgcgccggccgacatcgcgtccagcgtgatgcgggcgcctttttcggtcaacgacgagcagatgatgaccggcgtcggccgctcctccatgattttgcgcaggaaagtcaggccgtccatccgcggcatctcgatgtccagcaggatcacgtccggccagcgcagcttcatccggttcatcgcgaagatggggtcgggcgacgcgcctatcacctcgatgtccggcgcggtggccagcatctgccccagcacttcgcgcactacggcggaatcatccacgatcaggacggcgatgctcatttccctcctcctctcatccgcgaggcatccagccggtagcgggacggttcctcctggaccagcggcagcgccagcttatgcagcgattcggaatgcccgatcagcagatggccgccctgcttcatccgggtgcacagattggacagcacgctcagcttggtcgtctcattgaagtaaatcagaacattgcgcaaaaagacaatatcgaattcgccatggtggaacttgtcgcaatgcagcaggttgagattggcgaaatccacccgccgcgccagttccggcgccaccttgaccatgccttcgtattcatcgtggccgcgcagaaaatatttctgccagaaatgcggcggcgtgcggcgggcgcgctctatcggatacaccgcgcgcttggcggcggccagcaccttggtgttgatgtcggtggcgtagatcttccagttgccgctcaaacccagcgcctcggccagcaccatggcgatggtgtagggctcttcgccggtggaacaggccgccgaccacactctgagcatgcccggccggatatcgcgcagatgctgcgcttcccgttccagccagtggaaatgctggggctcgcggaaaaaataggtttcgttggtggacagcaggttgatcgcccgctggcgctcggcatgcgcgcttgggctgcgcagcagctgccagtaggccgagtagctggccagccccaagtggcggatgcgtttggacagccgcgactgcaccagcgagcgcttgcccggcggcaggtctatccccgcctcgcggaaaatgaactggcggaaaaaggcgaattcctcatcgcttagcaccgggtcacgattcagcacgcgccgctcccgccctcaggccacctcggcatcgtcgttgaagtgctgctgggcgaccgactccgccatcgcgctcaactccgtcaccgacagcgcctgctgcacattcagcagaatggcgaagcgctcgttgatggtggcgatgccctggatgaaatcgccgcgtatgctgacgccgaaggtcggcgatgggtcgatgtcggtctccggtatctccagcacttcgcacaccgcgtccagcaggatgcccacctcgttgtagccgttgtccagccccggcagcgacagaatggcgacgcaggtggacggtttcagctcggtcaggccgcggccgaagcggatcgacaggtctatcaccggcaccaccgagccgcgcagattgatgatgccgcgcacgaagctcggcatcatcggcacatgggtgatgccgtccagctcgatgatctcgcggatgaagttgatctggatgccgaacaaatcctcgcccaggatgaaggtgacgcaatggaacttgccgctgccatgcgcggcgcccggattagcgcgctcggtcatgttggttctcctcagtatttggaaaacttgtcgtcgtccacgccttcgtcgaaatcatcgtcgtccgcctgcatcgagtgcggcggcgccgaggccgttttgcgcgcgccgccggcgccatggccgctcatgtgcagcgatatgcccttgcgcgcgtggcggctgctgcgcagcttgaactgctgcatcaggtcctgcagctgcatcgccgccgaactgagctcttccgaggtggagctcagttcctccgccgacgacgccgacgactgcatgccggtgctgatctgcgaaaccgcggtgttgatctggtcgatgccggtgcgctgctcgcgcgaagcggccgatatttcctgcaccaaggtggcggtctggtctatccccggcagcatttcctgcagcagcaccccggcgcgctccgccacgctgaccgagcgcccggccagatcgccgatttccttggccgccacctgcgagcgttcggccagcttgcgcacttccaccgccacggtggcgaagcccttgccgtgttcgccggcgcgggccgcttcgatcgccgcgttgatcgccagcaggtcggttttgttggcgatgtcgttgatcacggtgatgcgcgaggcgatttccttcattgcgtgcaccatgtcgcccaccgccttgccgctttcggtggcgctgtcggccgacttcgacgcgatgccctcggtgacgcgggcgttatcggcgttctgggtgacggtggacgccatctcctccaccgacgcgctggtttcctccacgctggaggccagttccgacgccgtctgcgccagcgagctggcggtggacgacacctgttccgacgccgcgcctatcgattcggacatcgagctgacctcggccagcgtatcggacagccggtgcgccatgcccttgatcgagtacagcaggctgctgctgtcgttgccgttcagcttgatcggcaccgacaggtcgccgtcggccacccgcgccaccacctgcatcgcgtaggatggatcgccgcccagctggcgcaggatgctgcgcgtcaccagcagggacagcgcgccgcaaatgagcaatgaaatgatcgaaagggtgatcaccactcgcgttgtggaggcatatgtctcctgacccaatgtatgcgtcttttcagcgactctctcattcacttctttcacgagcgtcagtgattgctcgacaatatcaaaagcgggtcgcgccttgcttctcacaatctccattgcccgtttgcgcccttcccccgtgcctgggtcttcataagccagcttcatggcttccttgcttgcgctcaaataaataggccattgcgtctgccagcgcctattggcatcagcttcttctggctccatggtcgagcctagttccaacttcatctgctggaacaactccttgtcatattgatccatgtgcgccgcggcatcatccattttggccttgtcggtttctgccagatatcgataaagcgctcggttgtgcgtcatcgccgcgactctggcgttgctgatgccgatcagtgggctgaactgattggtgaataaatcctcgagacccgcattcactcttgcgctggcttggtaaccgacgatacccatcgtcaacaacaacgccagaagcacgccgaaactaagcagcagcttggtcctgacttgcaggttgtgaaaccagttcatgacagacctctctcctgaaattgtcaaaattagaacattcaagctctaatcccagtgcgtcgccgcttccgtgccctgttttatcaaccggcgttcgcgccggcaggcgtgatggatcaactgcggaatgtccagcaccagcgccggcttgccgttgcccaggatggtggagccgctgatgccgcgcagcgatttgaagatctcgcccaagggcttgatcaccgcctgcacttcacccatcagccggtccaccacgatgccggcgcggtgctcgccgtaatggacgatcacgatgtattccggctggcccgatggcggcaggccgaacagctcgcgcagggagacgaagggcagccagtcgccgcgcaggttaacctggcgcgcgcgctggctcatcgcgccgggcggcatgtccacgcattcgatcatcatgtccagcggcatcaccagcgccgattcgttcacttccacccggaagccgtcgatgatggccagcgtcagcggcagccgcagccggaaggtggagcccagccccggctgcgactgaatctctatctcgccgcgcagcgattcgatattgcgcttcaccacgtccatgccgacgcctcggccggacaggtcgctcaccgcttcggcggtggaaaagccgggcaggaagatcagctgcagggtttcctggtcgctcagaacccggccctcggcgaccaggccgcgctccactgccttggccagcaccttttcgcggttgatgccgccgccgtcgtccttcacctccaccaccaccgagccggcgtcgtggtaggcattcagcgtgaccgtgccctctggcggcttgccggcggccaggcgcttgtccgccgactccaggccgtggtccaccgcgttgcggacgatgtgcatcagcgggtcggtcagcttttccaccatcgatttgtcgatttcggtgtcgccgcccttgatttccaggtggatggtcttgcccagctgcttggacacttcgcgcaccatgcgcgggaagcggctgaagatttcgtccaccggcaccatgcgcagggtcagcgcgtcgtcgcgtatgctttccaccagggtgttgatcaccgccaccgattccagcagctcggcatcgccgcgcgcctgggcgatcagcttggtgccggacgaggcgatcaccagctcgcccacccggttgatcaaccggtccagcttgccagcctcgatgcggatgtattggccgtcgccgcggccgggcttgcttggcgcgccgccggccggctgcgcggccgttgacgccggcgcggggccttccagaactgcggcggtttcggattcgggctcgggctgccccaggtcgccgcgctcaatgcgggcggcttcggcctcggtcagcgctccccgcctgagccagcgcgccaactgctcgtccagcggctcgcccaggcgttccgccaaggccaggaaatccgccagcgaggcgtgcggcggcaggatgccgatcaggctgtcctcggcgatgaattcgaaggtgcccgcgatgcgctccgggctctccgccgactccaggctgagatccaggcccatgaagcactcggtggcgtcgaacagcggcagcggcggccaattgcgccacaccggctccgcctgcagcacggtgccgcatccggccagatagcgcagaaaggacagcggatcgaagccgtggcggaaggtgtcggcgtggaagcgcagcgacagctgccaataaggcgtctgcgtcgcgacggactcgctggcggccgctgcgggcggcgcagcgccctccgtctgcgcgtcggtttcgaccgcctcgccgtcctgatagcgccgcaggctgagcagcagcggctcgccttcgggcagatcctggcgcgccatatcgtcgctgatcgaggcgctgtccagcagccggcgcaaatggtcattgcaggacagcagcaggccgatcaggtcgtcgctcagcgccacctgtcccgaacgcagcctttccagcacgttttccaccacgtgggcgaagcggaccaaggcgtccaggccgaaaatgccggccgaccccttgatggtatgcgcggtgcggaacagcaggttgtaggtttcggcattgggcggataggccaccgggtcgagcagcgccgtttccagcccgtcgcacagctcgcgcgattcctcgaagaataccgccttggccttgctaagatccatgctccccctcccccgcgctctccatccgcgcggcgcctgtttctgcggcgaaacccagccaattgcccacctcgtccaccagcgcgttgctgccggcaatggagacatcgcgctccatccgccgcgcctcggccaacagcacgcacagcaattgggcgccgcagccatccagctccgttactgcggataggtcaagccgcacgcttgggtgattgagcaggccaagcagctcatcctgcagcatctcaatggtgaagatggtcaattcgccgtcgattgcggcccgcatcgcctcgccatcctgcgtcacttgaatcggcatgatggtttcggcttatggctggatcagcttggacaccgcgtccagcagcttgagcgggtcgaaaggcttgacgatccaggctttggccccggcctccttgccctgcatcttcttgtcgtcgctgccttcggtggtcagcatgatcaccggcaggaaacgggtggcggcgccttccttcagccgcttgagcaaggtgatgccgtccatgccgggcatattgacgtcggagatgatcagattgacgcgagcgccgttcagcttggccagcgcgtcgttgccgtcgcaagcctctatcacctcgtagccggcccccttcagcgcgatgctcaccgtggcgcggatgctggccgcgtcgtcgactatcaggatggatttgcccattgacacctccgggtggcggacagccccgctgtcctggtcggatcagaaaaagtccacgtcgccttgcgaggcctgcgccttggcgccggcgccctgatgcagcgccgcctgctccagcgtggtataggtcgactccagccgcttcatccattcctggctgctgatggcgggcggctcgcagccggttttgcgcgcctcgcgcgtctggcgcaggtgctcaagcatgcgctccaggtcgctggcgacatgctggatgatctggctgacccggtcctggtattgcagcgcgaccagcgaggcgttcagttcgcgctccacctgcgagccgtcgctctgcattttctggttgatttcggccagccggccggcggcggcgctgaagtcctgcaccgaggcgtccagcaagcccagcgcgccattgcccttgtcagcatcctgggcgcccaggctggtggtggattgccgggtctgctccagcgcggcgttgatggtttccaccttttccgacattttgatgccggtttgcgccgattgctgcgacagcttgcgcacctcgtcggccaccaccgcgaagccgcggccgaattcgccgacgcgcgcggcttcgatgctggcgttcagcgccagcagattggtctgattggagatattgcccacttcttcggccatggcgcgcagctccacggaaaaagtggtgagcttggacacttcgtctatcagcaactggcgatggctgacgatttccgacagcacgtgggaaatttcccggctgagcatgccggcgtcgctcaccatcttatccaggctgtcggcgccgatatcggtggcggccgagcgcgaagcctcgatggtggcatgcaggctgcctgcgatggcgctcaaggtggcggccacttggttgctgccggaggtggactgctccagcaccagttgcagattgcccatccagcgttgtatcaccgcctccagcaaggcgagattctcatcggcaggcccctggccggcatggctggcagaggcaggctcctctcgcggcgaaatgggagactcctgcttgcccgccagcaagcaagccgccgcgccgccgctgccggccatcagccagcccagccagggcgacagccaaaccagcgccagcgccgccagcgcgcaaagtatgaggtaggcgatcagaaaacgattgcggtttggcatgctggccatgctcccgactgtattgtgaatcgcgcgcgacagccctcggccgatcgtgtgccgccgcttctggcggaaattcgccatcggctgacgcgctagatcgtttcacttaagatgtcggcgttgacggtgtcaaggcgcggcgctcaggcgcgcgtagctgccgtcccgcttcatcgccgccagcgcggcgtcgaaacgctggcgcagcccggcgaggctgcgcttgcgcgcgaaagccatatagctgggaatggcctccagcggcggcgacagttcgcgcaccagggcctcctcgtggcgacggcgcaagatatcgcgcgcgcccagccggttgctgaccaggatgtcgaagcgctgcgccagcagcatgtccatgttctgctcgccgctggcggcgacttcgcccactttgatctggccgctcttcaccgcctggtcgaaaaccacgccatagctgacggcgcgcaccacgccgaaacggtaagcggacaacgcatccaggcgaccgccggacgaaatgggcgaatccttgcgcacgaacagcgacacctcctgctgcgccagcgtctcattggaataatcgagcagcgcttcccgttccggcgtgcggtacagcgtgaagatggcgtcggcgcgtccgtccgtcaccatggcgatggagcgcccccaggggtagacgctgatatggaccgccagattcagtctgcggaaagcctcgcgcaccagatcggccgcgaaccccttcacctcgccgttttcctgatactggtacggcgggtactgcagcgtgaccagctccagcgccggggcggcgcgcgccggcgtcccgcagcacaatgcgaacagcaagcccgccagcgcgattctcgacattggccctttcccataagacagcggccgaagcccgctcccggccgggagagcgcttcggccgcccatggcggggatcccccaccgaggtatagcccaatggcgagggtcagatcaggttctgctccgccacgttcaggttcaggtctatcatttgctcgctgcccgcctggtcctgctgcttcaggtccagccgcgcgcattcgatggcgtccagataggcggcggtgatgtcgccggtgatgtattcgccgtcgaagcaggagctttcgaagtcgtgcagctcgcgattggcgctgcgcaccgcgtccttcaaggcttctaggtcctggtagatcaccgcgtcggcgccgatttcgcgggcgatctccgcctcgtcgcggccggtggccagcagctcggcgcgggtgggcatgtcgatgccgtagacgttggggaagcgcaccgccggcgcggccgaggcgaagtacaccttccgagcaccggaatcgcgcgccatctgcacgatttccttggaggtggtgccgcgcacgatggagtcatccaccagcagcacgttgcggccggcgaattccagcggcaccgggttcagcttctggcgcaccgacttcttgcgcaccgcctggccgggcatgatgaaggtgcggccgatgtagcggttcttgatgaagccctcgcgatacggcaggcccaacgcgttggccagctgcaacgcgctctggcggctggagtcgggaatcgggatcaccacgtcgatgtccagctccggcaggtcgcggcggatcttctccgccagcgtctcgcccatgttcagccgcgactggtacaccgacacgccgtctatcaccgagtccgggcgggcgaaatacacgtactcgaacaggcagggcgcgtggcgggtgtgcttggcgcaggggcgggagtggaattcgccgtcgaagctgatgaacacgccctcgcccggctgcacgtcgcgcagcagcgtgaagccggagcagtccagcgccaccgactcggacgccagcatgtattcggtcttgggcaggctgtcgttgacgcctatcaccagcgggcggatgccgttggggtcgcggaaggccaccaggccgtagccggcgatcatcgccaccaccgcgtaggcgcctcgcacccggcggtgcaccgcctcgatggcgccgaacaccgcgtccacgctcaggtcgtggcccttgacccgctgcgccagctcatgcgcgaacacgttcagcagcacttccgaatcggagttggtgttgatgtggcgcaggtcgtggcggaacatgtccgctttcagctcttcggtattggtcaggttgccgttatgcgccagcacgatgccgaacggcgaattgacgtagaacggctgcgcctcggccaggcaggaggccgaacccgcagtcggatagcgcacgtgggcgatgcctgccgcgcccagcagcgagcgcatattgcgggtgcggaacacgtcccgcaccatgccgctgcccttgtgcatgtgaaaggtcttgccattggcggtcacgatgccggcagcgtcctgcccgcgatgctgcagcacctgcaggccatcgtacagcagctgattgaccggggattgaccgaccacgcctagaattccacacatctttaagctctcttcccaactacctgaaaacagacaagacaaagaaaaaggcggaatcttgaagtgaagatatcaagagattccgccttattcaccttaactatccggcgcctggccggtggtgtagtggaggttgtccgccagtatcggcggcaaccatggccttaatgacaaggccaatgattcgaatggcaccgagagcaccgcattcctccacatcggtttctgcggcaaactgctcaagccgcctatcaataccagcgccgtcaccagcaccacgccgcgggcgaagccgaacacgccgcccagcaggcggttgatcaggcccaggcccacgctgtccagcaaaccggtgagggtgacgcgcagcagcgcgctggccagccacaccaggaaaaacaccagcacgaagccggccaccagccgaatgccctcgccgggcaggctttccggcagaaagcccgccgccagcggcgaaaactgcttggcgcaccagaaggcgatcagccaggagcccagcgacagcacttcggcgatcagcccgcgcatcagcgccaccagcaccgagccgccgatgacggcaatagcgatatagtcgaacacagtcatggcggctacttgttaatgatgatgccgttgatgccggacttcgccagcttctgcagcgtgctctgcgcttccgcctggctcgcgaacgggccgacgcgcacgcgggtcacttcgcccttgctggtttccaccttggagaagtgggcgctgacgcctatgccggacaatttggcgcgcagcgcgtccactttggccgggtcggacagcgccgccagctggatgatggatttgccgtgagtttcggccttggccgggcgcggctcgggatcgaagcggccttccagaatggcggccgggtcggccttgcgcggcttgctctccgctttgggctcggtcttgggcttggcttcggccttcgcttccctaggcttgggctccgccgcctgggcgacggccggcttcgccggcgccgcttggggcttcactgtttctttttccgccggcagcggcgcggtgatggtggacagattggccggcagctcggtggccggcgcagccgccgcttcggccgccgagcccgacgcggtatgcttgctccccagcggcgccgaggcaggcaccggggcggaggccgcgcccatgatttcaatcgattcgggcttcatctgctgttccggcagatggcccactacattccacagtacgacggtggcaatcgaaaccagcaccagcgcgccgaccagacggcggcgggcgcgcttgcgcagcagtatcagttcatcgtggctggacagtgccatgcattcctcaaaccgggtgacgccgggcttccatcacctcggcgacggtgtggaaagatccgaaaacgacgattctatcattgtcgccggcccgagataaggcggcagaccacgcatccgccacagagccgaagctttcgacattggcgagacccgcctggcgcaacgccgcggcgatggtttcgccgctttggccgcgcggcatgtccagccccgccgtcagccagtggtcgaattcgccgcgcgccaattccgccaccgcggccagatccttgtccgccagcatggagaacaccgcgtagcgggtttccgcgtaaggcagctgccgcagcgccgccagcatcgccttgaccgcgtgcggattgtggccgacatccagcaccaccgccggccgccccggcagcacctggaaacgcccgggccactccacctccaccaggccctgcttgatggcgccgatgcccaccggcagcgtctccttcagcgcatccagcgccgccagcgccgcgcaggcgttgaccatctggtaagccccgcgcaaggcggggatgggcagcgcgtggcgctgatggccgccgcagcggaacgaccattgattgtccatgcgggtaaagccgaaatcgcggtcgtacagcttgagatcggcgccgatggcggcggcatggtccagcagccgctgcggcggattggggtcggcgcagatggcgggcttgcccgcccggtagatgccagccttctcgaagccgatgtcctcgcggttgtttcccagtatcgcctggtggtccaggtcgacgctgaccaccacggatacggcaggctcgaagatattgaccgcatccaggcggccgcccagccccacttccaggatgatcacatccaccttctcggcgatgaagctatgcaccgccgccagcgtgccgaattcgaaatacgtcagcgaagtctcgccgcgggcggcgtctatcgccgcgaagctggcgacgatgcgctcgtcgctggccggctgcagattgatggcgatgcgctcgttgtagcgcaagatgtgcggcgaagtgtaagtgcccaccttgaatcccgcggcgcggaatatgctggacagcatcgcgcaggtagaacccttgccgttggtgccggccaccatgatcaccgggcaattcggcgcaagatccatggcctggcgcaccttttccacccgggcgagccccatgtcgacggcgctgaggtgcagcccttcctgccagcgcagccagtcgtccagtgtctttcttgcggtcatggtgtggtttccgttgtatctgatggctgcggcggatggaaccacagcaggtataccctgagctggcggcgcgattcggcatcggccgagtccggccacagcatcaggctgacgcggcggccctccagccgcaggttgagcaccgtcagcagcggcgtgacgaagcaatcgtccagcacctgcgcctcccggctctcggcggccgcgcataggctgaggcggccctgggggtcaacctccagccgctgccaggcgccgttccgccgccagcctccggcgcgcagggcgcgccaggcgaaatagcccgccgccggcaggctgagcagataagccggcggcagatagcgcgacagcagcagcgcgtaggccagccagctcgccagcaccagcgccagccacagccgcgacggccgcatggcgacggcgaacggttgcagcagcggccggtctcgcatgccgggtgttacaggtcattggccgggtggttggtgatgtcggcgtcgacgctgtccatcaccatcgaatggatctccacgtcgaaccattcccagaaagccttcagcgacaggtctttcggccatttcgcctcgtcctcgtcccaggaggcgagctccatcttgaacagctgctcgctgatttcgtcgatatgggcgacgccctcttccggctcgacgaattccggcagcaggatggcggtgcagtcgctgcgcaggctgtccagcgtcagatcgatcatgtcggtgtccggcagctggttcagccagtccaggaacggttgcttgggtttgatgacggcgacggcgcgatcgacgaagtacatggtgcggcctttctgggcaaaacgatttggcgcgcattgtatcagtccgcccgcggctaggcgacccgtttgcctgcagggtttgccgccgcatgcccgtgttacactatgcgccgtttttccttatcgctagacacataaacatggccctcatcaccgtcgagaaagcttgcctggctttcggacaccacgcgctgctggacaatgtcgacttttcgctggagcccggcgaagtcatcggcctgatcggccgcaacggcgccggcaaatcctccttgctcaagagcatcgccggcgcagtgcagctggacgacggccgcatcaacatcaaaggcgacgtcaaggtggcctatgtgccgcaggagccggaattcaaccttgagcataccgtgttcgaggcggtggccgaaggcctgggcgacctgaaggcgctgctcaccgactaccaccacatcacccaccagctgacgcaggcggacgccgaccacgaacaggcgctggcgcggatggaaagcatccagcagcaactggaagcgcgagacggctggcagttcgacgcgctgatcagctcggtgctcagccacctggagttgaatcccgacgtgcgcatcggcgcgctgtccggtggctggaaaaagcgggtggcgctggcgcgcgcgctggcgtccaagcccgacgtgctgttgctggacgagccgaccaaccacctggatgtggccgccatcgaatggctggaaggcctgatcaagaattttgccggcagcgtgctcttgatcacccacgaccgccgcttcctcgacaacgtcgccagccgcatcgtcgagctggaccgcggcctgctgcgcagctatccgggcagtttcagcgcctaccagacgcgcaaggccgaagagatggcggtagaagaagagcagaaccgcatcttcgacaaattccacgcccaggaagaagtgtggatacgcaagggcatcgaggcgcgccgcactcgcaacgaaggccgcgtgcgccggctggaggccattcgccgcgaacgctcctcgcgccgcgagcgcgtgggccaggtgaatttccagctggacgccggcgagcgctccggcaagctggtggccgagctggagcacgtcagcaagggcttcggcgataaacagctgatccgcgatttcaccagccgcatcctgcgcggcgacaagatcggcctgatcgggccgaacggcgccggcaagaccacgctgctgaagctgatcctgggcgagctgcagcccgacgccggcgtggtgaaacagggctccaaactggagatcgcctatttcgaccagttccgcgagcagctggacgaagacatgagcgtggccgatgtcatcagccagggcaacgacttcgtcgagatcggcggcgccaaaaagcacgtgatgagctatctggaagacttcctgttctcgccgcagcgcgccagaagcccggtgaagtcgctgtccggcggcgagcgcaaccgcctgctgttggcgcgcctgttcacccgccccgccaatgtgctggtgctggacgagccgaccaacgacctggacatcgacaccctggagttgctggaagacgtgatcgcccagtactccggcaccgtgttcctggtcagccacgaccgcgccttcctcgacaacgtcgtcacccaggtgatcgccttcgaaggcgcgggccggctggaagaatacccgggcggctaccaggactggcaggacacccgccagcgcatggcggcgctgggcgcggcggacaagcccaaggaagccgcgccggccgctgccgccgcgccggcgcgccaggacaagcccaaggccgcgcgcggcaagctgtcctacaacgagggacgcgaactggcggccttgcctgaccagatcagcgcgctggaggcggaacaggccgagctgaaccagcgcctgctcgacccgaactgctaccgcgacaccccgcgcgaagccgtggcctggcagcagcgcatcgaggaaatcgacgagctgctgctggagaagctggcgcgctgggaagagctggaagccgcgcagcaacgcacgcgctgagtccgccgcctttgccgcgcgccggtgcatgaactacacaagtagaagactgcaataccggacgccggccggcacgggagcggacagcgcttttccctgccgcgctggcgcgcgctgcgccgcggcgaagcggctctatcatcgggggcaaggcggatggggttcacactcgcgggctggcaaggcaggcgcgtccgggcttggcgcctggccgcgtggctggcgcttgccgccgccgccgcgcacggcgcgccgctgcgcgcttgcgcctccgatatcgacttcccgcccttcgtgctgacctccggcttcgccgaaggcgcgcaaagcaccggcctcgccatcaatgtgctgcagcgggcgctgcggcgcgccggccgcgaaccggcggtggtggagcggctgccctggcgccgctgccgggagacggtggcctacggccagcgcgacatcgccatcggcgtgccgacccgggagctggacccgcggcgcttccgcgccacccaggctttcgcttccgtccacctgctctatttctattcggccaaacgccatcccgaagccccaccgctgcgcacgctggccgacctccggcgctacaccgtctgcgggctgctgggcagccgcctcgacgctttcggcatcgcgcccgagcatcaggacaccggctcgaaaaacgagcgcagcgccatcgtcaaagtcatcgaaggccgctgcgacctgttcatcgaagtcagcgaagtgatagacagcctgtccgcgcacgacgcggagctgcgcgacttgttcaacgcttccgccatccgccgcgccgccttgcccggcaacacgcccaccggcctgcatttcgaattcagccgcgcgctgaaggacgccccggcgctgcagcgctcgttcgacgccaccatccaggacctgatccgcaacggcgaaatgacgcggatgacgccctagccgctcacttgcccgccctgccgaacaccgtccgcgccgcgatcggcatcaactggtctacgttgcggccggtggccaccaggatgggcaccagaatttccttcgccggctggtggccgcgtagcgaggacagcagcgccccggcggcggtgctgcccatcagataaggctgctgcatgccgaccgcgatcaagtcgccgcttttcagcagacgcgcgacctctggcatcgcgtcgaacgaaaccagcagcacctgcccgctcttgccggcctcgcgtatcgcccgcatcgccccctccaccggctgatcggtttcgatgaaaaatccgcgcatcttcggcctcgccgcgagaatctccctgacatagcggtaactttcctcggccgagtagtccttcatctgccgcaacgcggcttcggacgcgaagccggcatccttcatcgcgtcgcggaagccgtcggtgcggtcctggccgtttttgcgcgtcagctctatcgtgatcatgccgtagctggcgccagtccagccgcgcgatttcagcgccgccgccaactctgagccgacatcgtaagcgccgcggtaattgtccgacttgacgaagctgacgtagtcgccgccattgctgccgatatcggcgatggcgatgggagtgttggcctttttcgccagcctcagcgcgtcttccgccgatttgctgttggtcggcgaaatcacgatgcccgccgcccgccgctctatcgcctggcgcacattcgccagctgcgcatccgcgctgagcttgctgtccagcatcgaaaacgtgtatccgccggattcggccgcggccctgacgcccttgccgaccgtgtcccagaacggcagatcggccttggcggcgatgtagacgatttccgccgccatcgccggcgccgccgccaggccaatggacaaggccagggccgccagcttggccagccaggcggagccacgcgcgcatcttgctgctttgccactcatctcgattctccccgaaccctgccatatctccattctagtttgcccggcgcgctcggcagcgttgatgcggcgcttcaggccatgggcatcgcccagtcacaggtcatcgcaatttgccgccaggatttacataggcttaacggcgggccggcggactcgcgctatactttcggcaaagcgttggtcctggctcccccgcggaacagtcaagacacgccagccatgcccgttcatgcggccgcgccgccagatcgcgcagaaatcgccaagcgccgcatgaacctgacaggagtccaagcctcgatgaaagaagatttaccgatcgaaaccggcccaagccgccgccgtttgctgcagagcgcggcattggccggcctcgctgccctgctcgccgcctgcggcaccaccccgccgcagaaaaccagccagcgcccgccctaccgccccggcaaacccggaggcgatgtctcgctctccaatctgcaggcggatggcaacggccgtgaaatcctgctgtacaccataggcttgctggatggcggttaccagttcggcggcaataacccggaagccggcctcgactgcagcggcatggtcagctacatctatcaaaacgccgtcggcatcaagctgccgcataacgccgccaagatcgccggcctcgcccggcccatcccggacagccagatgcaggtcggcgacctagtgttcttcaacaccatgagccgcccgttttcgcatatgggcatcttcatcggcgacggcaagttcgtccatgcgccgcgcaccaacagcaccatacgcgtggcccgtctggacaatgtctacttcgcgccccgctacgaaggcgcccgcaccgtattgcgcacctgaatctggccgccattcggcccgggatgcaaaacgtggcgctgtcgggaacaatcgccctccctgccgcgtatatcctgctgggagcgagacatcattaccgctcctccgcccgccctgtcatgcctcatgcatgggcagcgccagtcctggcttctctctcccggagcgccaggacgacgcgctacgccagccgtgggcgctgccccagagcgatccggtgcccgcagatgtaagcccggaatggctgtgataagctgccgcatccacaatgcattccgcgacccgcaatgaaactgaaattcagcaagatgcacggcctgggcaacgacttcatggtcatcgatggcgtcaggcaggccgtggcgctcacgccggagcgcatccgccaactaggcgatcgtcagatgggcataggctttgatcagctgctgctggtggaggccccgcgcgaggtcggccatgatttccgttaccgcatcttcaacaacgacggcggcgaggtcgagcaatgcggcaacggctcgcgctgcttcgtcaaattcgtctgcgacgaggggttgagcgacaagtccgggatcgcggtggaaaccgcgcgcggcgtgatccgccccgaatatctgggcgacggcatggcccgggtggacatgggcgtgccccgcttcgcgcccgtagacatccccttcatcgccgaacaggaagcgctgagctatccgcttgagctggaagacggcccatgcgtcgtcagcgtcgcctcgatgggcaacccccacgccgtgcagctggtggatgacgtggacaccgccccggtggcggccatcggcccgcaagtggaaagccacccgcgcttccccgagcgcgtcaatgccggcttcatgcagatcgtctcgcgcggcgaggtccgcctgcgcgtctacgagcgcggcgccggcgaaaccctggcctgcggcaccggcgcctgcgccgcggtggtgagcggcatccgcctgggcctgctggacgcgcgcgtgctggtccacgcccgcggcggcgacatggtgatcgaatgggccggcgctggctgcccggtgatcatgaccggccccgccgtcacggtttttcagggcgagatagaactttaacgcccttagagacaccaaccccactagccgcatcatttcgaaaggacaaggcagatgcacagcgaacaggttctggcttttctcgatgaacaccccgacttcctgcagcagcatgccgctcgcctcaacctgcaggccgcgccgcagaacggcgaacgggtggtgtcctttgtcgagcgccagttgctggagctcaaggaccagaatcgccaactggaagcgcagctgcagcagctggtcgagcgcgcgcagaccaacgagcgcactgtcgcacggctgcaccgcctgacgctgggcctgctggccagccgcgagctgaagccgcaaatcgaggcgctcaagcgcagcctgcaccaggagtttcagctggaccgcgtcgcgctgaggctgtggcacccggcggcggaaagcgaggccgggcattacaacgcgcagaacgacgtgcaagggctggcgcgcaatctcaccacgccctactgcggcccctatgtcaacgacgaggtgatgagctggttccccgccacccccgtgctgcagtcattcgcccaggtggcgctgcgcggatcggacggccaggctttcggcctgctggtgctcgccagcgacgatgcgcagcgcttcaccttcgacatgcatacccagtacctaagccagatcggcgaagtcctgtccgccgccctgctgggcgcgctggaggctaaatgacggcaacgccggtcggagtatcgctgctgctggtcgtgctgctgttcttcctgcatgcctcatggcggctgatcgccagccgcagcggcagcgccatcgcctgctttctggccgcttacgtgatgctggcggccctgctgaactgccaccccgagcctatctcgttgaccccgctgctgctgcccttcatctacgcctatgcttggctgggcatcgccgcggcgctgtgggcggcggtgatgatgcgggtgacgcgcaaggcgctgctgtttccggggcaagacaaacggctggccgcgctgttctccagccagctggctttgcatgtcggcgtgtttggcctgtcgccgtggctggattggcggccgctggccgcttacgcgatggcgccgccgcttctggccttcgtcagctacttcgcctatcgcgcgcagctgttggccatgcgccggcgggaggattgcggcgcgtcttgggtatcctggggcgccatgtgcctgttgttgccgttgatcctgatgtggctggcgcaatggctgactcccgccatcctggatctgacctgatctgccccatgcccctgggcatgagaaagcggcgccgattttcggggccgcttgcgtttggactccgtttccggcgccgcgcgttcaggtttgcggctcttgccgtcgcaccgtagcttgcgtgtccgtggccgcccggctgcgggtgagcgaactgagcgcgatgccgctgaagatcgcagccaggccggcagcgtggtacctgtgcagctcctcgcccaaaaaccagatcgattgcagcgcgccgaaggccggcatcagatacaggaaactggccgccttcgccgtgcccaccatgccgatggcgcggttgtacatcagataggcggcgaccgacggcagcacgcccagataaatcaggctggccagcgcggggccgtccagcgccggcagcccccgcccggcggcctccgcggcgaacaagggcagcaacagcatctcgcccaccgccagcagcacgctcatcagcaccagcgagtctatgcccggcttgagtttgcgcaggcccagcgtgtaaatcgcccagctcaggccgccggccagcaccagcaggtcgccgccgccgaaatggaagctggacaaggctgccggatcgcccctcagcacgatcagcaaggcgccggacagcgccaccgccatgccgccccactggcggcggctcagccgctggcgaaaatacagcgaacccagcagcagcaccatcaccggcgtcgcgctgttgaggatcacggcgttggtggctgatgtggtctgcaccgcccaatagacgaaggtattggtcaggcctatgccgaaaacgcccagcagcaacagcaaaggccactgcgcgcgcagcttcgccaaattgccgcgcaaacgcggcagcgcgaacggcagcaggcagcacagcgcgatgccccaacgcgagaaggccagcgtgaacgggccgacctggctatgcagcgcgcgggcgatgacgaaattggtggaccacatcaacatggtcagcaccagcaggagataggcgttgcgggaggtggagcgggcagacatggcaagcttttgaatgaaagtgcgccattttaaaacatgtcaatgatttattatgctcaatgttgtttatttattaaaataaacaaccattttaaagtaaataaatggattaattttccagtaaattcgcaaatcacgacttatacaacctaagcaaggcagccagcgtcacggctgccagtcctgataaggctgatgcaccttggcgtaagccttctgcagttcgccgctatcccgggcggcgcgtatcgccgcgctcatcgcttggttgacgaagtcgccgcgcttgttgcaggagaagaacagcacatccggatagtcgtccagatgctcgcgatggatatggccgagtccgtccttgcgcaccaggtagtccgcatcctcctgcgcccatatcaccgcgtctatccgccccaggttcagctgtttcagcgacagctccagattgatcacccgactggcgggaaagtcccagctggccggcggcgcgtgtatcgccacctcgtacttgggcagcgtggccatccgcagcaggtcggccttgccgaacggtttttccttgttggaatagatgacgaagctgaccttgcccaacatttcatgggaaaactggaacggcgtgccccgatcggcgccttcgcggattttcatgatgggaaaacggaaatccacgcttttgtcggaggtgtccaagtacacccgcttgactggctcgatgctgaagcgtatccgcccggccggataatggcggccgacgactttcagcaggtcggcgaaaggcccggaatcgctgctctccagcactttgggcagatacaccgcgatgccttgcaagtcgggcgcgtcgactgcggccgcgctgtcgggtgccggcgcgccgtcgcaggcccgagccggcaagacgaacagacacgccagaagcgcgccaagccaagtgtgcaccggtgtcatcgccatcgctcccgccaagtccgccctggttcaggtgtagcacagccaggacggaacggcgccggctcaggagcggccggccggcggctgccaccattcaggatgctggcgcagcggctgcgccatttcgccggacaaggcgtccagcaggctttgcaggccggccagcgccgcgtcgacgccgggggcggccagcgggatgctgcggctgaagctgccggcggccagcagcttgccgtcggacacgccttgcaactgccacaccacctccagcgcagcctggcgtcccggctgcaggctgagccgccgcacgtccagcgcgtagcgcaggtcgccgccgtccattgtcggctgcggataggcgtagacgctggcgacgccgctgcggcgcgacaccgccagcgtcaggctctgcgccagcagccggtccagcggcgcgctccagcggtcgaactcttgcagccgcaaccggccgccgccgtcgtccagcaccaattgcggcctgtccagcgccgccggcaggcttaccggccccaacatcacgcgtttgccgaattgcgccggctcgccggatgcggcggacgcggattccaggctgtaaaagcgggcttgcggcgacgcgcagcctgccagcgccagcaacagcatgccggcgccgctccatcgtcgcagactcatggctgcgcctccttgccccgcaccagcgcttccgggtggcggtccagatagtctgccagcgcgcggaagctgcgcgcggtttccttcacttcctgcgccgccgagcgcacgtcttgctgcagcggcgagtctgccttcatggtctgccgggtagcgtccagcgtctgctgcagctgctccagcgtcttcagcgtctgcggcagcatttcgccgttgatgccgtcggacagcttgcgcatgctgtccagcgtctggtgcagcgacttcagcgaggcgtccatctcctggcctatgctgtcgaacggcaccgcgtccagctttttggcgatgcgctgcaacacgcgctgcagctcttccagatcgcccgggatggtgggcagctcggcgatgccgccgcgcaccaccagcttggccggcggcgcgtcgcggaagaagtccagcgccacgtacagctgaccggtgatcaggctgccggagcgcaactgcgcgcgcatgccgttggccaccagctgttgcgacgacagcttgcgcgagatgcgcgagccgtgcgacaggctgtccaaccggctggggtaggtgcggatgtccaccgtcatgtcgaagtccttgcgttccggcacgtattccacgcctatcgccgtcacctcgccgatgatgatgccgcggaagtccaccggcgcgccgatagccaagccgcgcagcgactggcggaagcgcaggcggaaggcctgcatttcgcggtcggggttctgcaacgctttatcgcgggtgtcgtgcaggatgaaattgcggtcggacaaagggatggcggcattgtccgacagcggcgtttcaaaggcgatgccgcccaacgcgatcgccgccagcgactgcgtgttgacgttcagcccgttggcgctcagcgacacgtcgacgccgctggcgtgccagaagcggctgttggcgttgacgaaacggtcgtaaggcgcgttgatgaacacgctgacgcgcacgaaactgcccttctggtccagttcgtaccccactacttggcccaccggcacccggcggaaatacaccggcgagccggtgttgagcgagcccaggttgtcggcgcgcaggaagaaagtctgccccggcaggtcggcgttgatgatgggcggcgtttccaggccgacgaattcggtcttgcgcgccaagcttttgcctacgtccatgccgatataggagcccgacagcacggtgcccagccccgacacgccgccgccggagacgcgcggccgcaccacccagaagcggctgtccgccgcgaggtagtcgttggcctgtttgctcagttcggcggtggccaggatggactggcggtcggcgctcagcgccactgccgtcacctcgccgatttccacatccttgtatttgattctggttttgccggcctctatcccttcggcgttctgaaaggatatggtgatggtcggcccgcgcgacatgatggcgtgcgcggccagccagccgcctatcagcgcggccaccacggggatcagccacaccagtgacggcgcccagcggcggcgcttcaacaccacggcctgcggcagttgcggctcctggccttgcggttctaccggttcttcactgctcatcttcttcctctacgggatcccagatcattctgggatcgaaactcattgcggccagcatggtcagcaccaccaccgcgccgaaagccaccgcgccggcgccggccttgatgctagccagcgactgccattgcaccagggccaccatcagcgccaccacgaaaatatccagcatcgaccacggcccgatcagctctatcagccggtacagcccggtgcgctgccgcggcgcccatgaccagcgccattgcacgctgcacagcagcaacagcaaggccagtatcttcagcaacggcaccagcacgctagcggtgaacaccaccagcgccagcggccaggagtcgttgttccacaaatagaccacgccgctgagtatggtgtcgcgctgcacgccggtcagcgcggtggtttccatgatgggcagcaggttggccggcaaatagctgatgatggccgccagcagcagcgcccagcagcgctgcagcgccgccggccggcgcaggtgcagcggcgccctgcaacgcgggcaaacgccggcggcgccggcctccagccggcatagcaggccgcagccgtggcacagcgccaggttgcgcgccgccgcgcttttcattccgtagcctggcatgcctggtagcgctcccacagttgcaccggcttgaagcggctggcgcaagccgccatcagcacgatcaaaccgaaaaaagcccatagcccgatgccgggatgcactgccgccagatgcaccagcttgaccagcgaaaccagcacccccagcaggaaaacctccaccatgcaccagggccgcgccagctgccgcagccgcatcaccgccgcaaagcccggcggcgcgcgtccgtactgcaggggcagcagcaggtacagcatgctggccagctccagcgccggcatcacgatgccggtgaacagcaccagcagcgccacttccgccatcccctgcccttgcagcgccaacgcggtctgccacagcgtggcggcgttgcggttgccggcgatttccaagaccagcaccgggtagctgttggcgatgacgaaggccaccgcgccggccaccgccagcgccgcgccggcatgcagcgcgccgtcggcctgctcgtgcagcaaggcgccgcagcgcgggcaatggatgcaggcgcggtcggcggcggcggccggcagccgcagcagcaaatcgcaatcatggcaggcggccagcggcccgcgcggcggcgtcactgcggccatcggcgcttgcgctccgcggtgaagctccaccagctgcgagcttcgccggtgtccatgtaatggcagatggacagcatcacgtccagcacgcagggatcatgccgctggccggttctatcgcacaactccagataaagctgatgaggatcgcggccgcgcagctgccctggctcttggatgcccaggcgttccagatcggcagccgcgcgcggcccgacattgggcaattgcagcaggctaaacgccgcgtctggcgcggggcaacgagatggatgcatggaaaggaaccgccaagtagtcattctgcctacatgataaaggagcgggacgcgcagttcaaagcgcgtcccgctcccggcggccaggccggcgcgcgatcagccgcgcagaatgtcccaacccagcttgcagatcagcacgctggtcagcatcaagaacaagatgcggacgaaaccggcgccctttttcatcgccaagcgcgtgcccaccatcgcgccggccatattggccgccgccatcggcagcgcgtaggccagcaggatatggccgccgatggcgaaggacagcagcgccgccacattggtggtgagattgacgaccttggccgccgccgaggcgtgcaggaagtcgaaggcgaaaaagcggatgaacaggaacatcaggaaactgccggtgccggggccgaacaggccgtcgtaaaaaccgatggcgccgcctatcgccatgcccatcagcaactcgcgccggcctatcgccaccggcttgtgcagcttgccgaaatctttcttccacagcgtgtacgctgccatgatcagcagcagggtcagcaccaagggccggatcacgtccttgggtatcagcgccaccacctgggcgccggcgaacgaaaacacgaaggccatcgccgcgcaaggcagcaccagtcgccaaggcaaccgcacccgacgcagataggagcgcgccgccgacaaggttcccaccgccgacgccagcttattggtgccgaacaaggtggccggcgccacattcggcaaggcgctgaacaggcccggaatctggatcaagcccccgccgccgacagcggcgtcgaccagtccggcaaaaaaagcgatcacgcacaaaaaactcaagctcaacaacattggcattctcctccttgcacgcattctaaggcctgggccagattcatgcttgcaatgtaatattgcaataaacgcaatactggaggcgcgatgaagccgctatggggagtcaggatattttgcgcggtggtggagcgccgaagcttcgtcgccgccgcgcgccagctgggcacctcgcccagcagcgccacccgcgcgctgcaggcgctggaagaggaaatgggcgcggcgctgctggcccgatccagcaagcaggtggagctgaccatggccggcgaggcttattatcctatcgcccggcagatgctggacctgcagcagcaggcggaagaggaactcaatcagcaagtcgccgcgccgcgcggcctgctgcgcttctccgcgccggaaacgctggggcgcggcatcctgccgcgggtgctggcccgcctcgccgaggaaaacccggacctgcgcttcgacgtgctgtacagcgacgccacgctggagccgattcgggaaaagctggatttcgccatccgcggcgcgtttcccgcctccagcgaactgataggctatccgctatgggactaccggcgccatctatatgccagccccgcctacttggcgcgccacggcgcgccggccagcccgcgcgagctgcctgagcaccgggtgatcatccacaccgcgccgcgcgtgctgaaagcctggaacttcgtcagcgcgggcagccagatcagcctcaacctcagcgcctggcaccgcagcaactccggcaacggcgtgctggaggcgattcgcgccggcatgggcatcgggaggctgggagactggttggccgagccattggcggcaaacggcgaactggtccggctatgtcctgagtttcgcatcgtctccagccatggcgacgatccgcaaatgcacgcggtgttccccagccgcaacattccgcgcaaggctcgggtgctgctggatgcgctgcgccaagaggggcgcgccgcggcgatacccgcgccatgaaagcgaaaaccccgccgagaggcggggttggcggagcgaatgcgtccgagcttactggctattgtcgttcagcgactgcttgccggccgtcaccgggtacttctgccgcagcgcctgcagatagctgcccaattggttattggcggagatctctcccagcaccccgcccagctgggcgcgatcggcttcgctgacagcgggagccgcaatcaccttgttcacgcggtaaatcacatactcgccggtatcgtggcgcacgccggcgaaccccggcagcttggctgcggccacgctgaacaccacgcgcgcatcggccatcggcaggccgccagacgcgcggcgcgataccgtctgctcggcgccccacttctgcgcgtccacgcccttcccagccttcagctcggccagcaatgcctggcctttcttgtcggccagcttggcgccttcgcgctcaaccagttcgcgcctgatgtcttcgcgcacatccgcgaccgggcgctggcgctctggctgatgctcggccacgcgcgccaccaccagacggccgccgccgacatccacgacttcgctgttgtgctttttcttcagcacatcgtcgctgaacaccgccgccagcaacttgtcgttgcccagcagctcatccttgcccggctgattgcgctgcagccagtcggagtgtttgacttccagcttcagcgcatcgaccacgcccttcagcgagtcggcctgctggtaagcgacttcgttcagcttgtccgcttgttcgcggaacagggccgaagctttctgcttctgcagtttgtcgacgatggcggccctggcctcttccagcccctgggtcttgatcgcatccaggcgaatgatgtggaagccgtagtcggtttccaccaggtcgctgatctggccaggcttcatcgagaacacggcgtcgtcgaacggcttgaccatcatgccgcgcgcgttgagacccaaatcgccgcccttctccgccgagcccggatcctgcgacttggccttggcgatttcggcgaacttgcccggattggcgcgcacttccttcagaatggcctcggcctccgccttgatcttggccttctgctcaggttttgcgcccttcggcaccgtcagcaggatgtgcgaggcgcggcgctgctcgctggcgaggtccgacttgtgctgatcgaaatacttctgcacgtcggcgtcggacaccttgacgctttgcgccagcgcgtcttgcgacagcaccacgtaatccagcttgacgctttccggcgtgcggaagcgcttggcgttggcgtcgtagtaggccttgaccgccgcgtcgtcggttttcacttcggcggcgaaatcggacggcttcagcgtcagcggctgcagcacgcggccttcgcccagcaatgccgccatgcgggtcaccacggtgttggacacgaactgggtgccggcgacggctgtcagctggttcctgatcagcatgtcctcgctgatttcggcttcgaaatcggcggcggagcgatagcggtttttcagaaactcctcatagcgctgcgggctgaactggccgttgtcctgaaacagcggaatggaggcgatgactttgcgcagctggtccgggctgatggcggcgccatgatcgcgggcgtcggccaggaccagcttgttgcggatcatttcctccaaagcggcctgacgggtggccggatcgctgggcttgccctccagcgcgcgatcaagatcgcgcttggatatcttgacgctgcccaccttgaccagataggggtctgcggtgacgtcgctgtagctgctgacgccgaagccgacgaaagtcagcgcgacagcccccaggatgacttgaatgacggttttgttgttctggacaaactcgaacatgacgattggctaaggccacccctgtaaaaaaaaaggtgaacgcgttgaaccggttcaccttctctcgtgtatttggcggagcggacggggctcgaacccgcgacccccggcgtgacaggccggtattctgaccaactgaactaccgctccggaccttggtgggcgttgacggagtcgaaccgccgacattctgcttgtaaggcagacgctctaccaactgagctaaacgcccgtctgccccgccgcggaaccggtcagaccggccctgcggcaggggcgccgattatagcgcgtctttcagtgccttgccagcacggaacttcggagaacgtgcagccgggatcttgatggtttcgccggtcttcggattgcggccgctacgctctgcgcgctcgcccacatagaaggtgccgaaacccaccagagtcacggtatcgccttttttcagggcgtcggtaacggcagcaaccatgccgtccagagctttcgcggcagcggctttggaaatgtcggcttctgccgcgatggcgtcaatcagttcagacttgttcacgtaagtcccctttcgtcgttcttcggtctacgtaattcggataaaaacgcttgctttatagcaaggcggaaatccttgtgtcaagcggcttccacgggtgttttgctaattcgcaagcacatttggaagccgcgaaaccacaagatattcacagcttcggtaaggccatgattcttaatgcttcaaaaccgacactccgccggaagcatcttgcgcaggaggaatgtccgcggactgttcttcttgcgacaattcttccggctgacgctccagcgccagcgccagcacctcatcgatccatttcactggatggatttcaagcttctgcttgatgttggacgggatctccgccaggtctttctcattgcccctgggaatcagcacgtggcgaatgccgccgcgatgcgccgccaacaacttttccttcaaaccgccgatcggcagcacttcgccgcgcagcgtgatctcgccggtcatcgccacatcggcgcgcaccggaatgccggtcagcaccgacacgatggccgtggtcatcgcgatgcccgcgctcgggccatccttgggcgtcgcgccttccggcacgtggatgtgcatgtcgctcttctcgtagaagtccggcttgatgcccaggcttctggccctgctgcgcaccacgctcatcgccgcggtgatggattcctgcatcacttcgcccaactggccggtgcggacgatattgcccttgcccggcagcgtgaccgcctcaatggtcagcagctcgccgcccacttcggtccaggccaggcccgtcacctggccgacgcggttttcctcttcggccaggccgtagtcgaagcgccgcacgcccagatacttgtccagattcttggccgacaccgtcactttgcccgtcttgcccggcttgagcaaggcgccggtcaccactttgcggcagatcttggccacttcgcggtccaggctgcgcacgccggcctcgcgggtgtagtagcggacgatgtcgcggatggcggactcctgcaccgccagctcgccctcgcgcacaccgttggcctccatctgcttcggcagcaaatacttcagcgcgatgttgaccttctcgtcttctgtgtagccggaaagacggatgatttccatccgatcaagcaaggccggcggaatattcagcgaattggcggtggcgacgaacatcacgtcggacaggtcgtactcaacctcggcgtaatggtcgatgaaggcgtggttctgctcgggatccaacacctccagcagggcggacgacggatcgccgcggaagtccgcgcccatcttgtccacctcgtccagcaggaacagcgggttcttgacgccgaccttggacatgttctgcagcaccttgcccggcatcgagccgatataggtgcggcgatggccgcggatttccgactcgtcgcgcacgccgcccagcgccatgcgcacgaacttgcggttggtggcgcgggccagcgactggcccagcgaggtcttgccgacgcccggagggcctaccaggcacaggatgggcgccttcaggcgatcgacgcgctgctgcaccgccaggtactccagaatccgttccttgaccttctccaggccgaagtggtcctcgtctagcacagcctcggccgcggccacgtccttgctgatcttggtcttcttcttccacggcaggtcaagcagggtgtcgatgtagttgcgcaccacggtggcttccgccgacatcggcgacatcatcttcagcttcttcagctcggccagggtcttgtcgcggccttccttgctcatgccggcagccttgatgcggcgctccagctcgtcgaggtcgctgacctcgtccatctcgcccagctctttctggatggccttgacctgctcgttcaggtagtactcgcgctggctcttttccatctggcgcttgacgcggccgcggatgcgcttttccacctgcaggatgtcgatctcgccttccagctgcgacatcagatgctccagacgtgtctggacatcgaacatctccagcacttcctgcttttgctccagcttcagcggcaggtgggcgatgatactgtcggccatgcggccggcgcggtcgatgccggccagcgagttcagcacttccggcgggatctttttgttcagcttgacgtactgctcgaactgggcgagcagcgcgcggcgcatcgcctcggtctcgttggactcttccagctcgctggacagcgggctgaattcggcgacgaagcagccgtcctcctcgcccacttccttgatggtggcgcgctggcgcccttccaccagcaccttgacggtgccgtccggcagcttgagcatctgcagcacagcggcgatggtgcccacgccgtacagatcttcggcggagggttcgtccttggaagccgagcgctgggctaccagcaggatctgcttgccttcgtccatcgccagctccagcgcacggatcgacttggcccgtccgacgaacagcgggatgaccatgtgcgggaagaccaccacgtcgcgcagcggcaacagcggcagcgtggtctcttctctgatttctgcgggttgggacatatcacctaaccttagctttggggaaacaatgcatggaaaatggggtgcaaggccagaatatcaacaccccatactaaaacagattacatggacgacaaataaaaaaccgccctgccgggcggttcagtcattcaggccaggctatcaggcggattgtgccacaccgccctcttcgcgatagatgaaaagcggcttgtcgcccttctcgatcaccttctcgtccaccacgactttttccacgtcctgcatggacggcagatcgtacatggtgtcgagcagcgcgcgctccaggatggagcgcaggccgcgggcgccggtcttgcggatcagcgcctgcttggcgatgacgcgcagcgccgacggacgcacctccagttccaccgactccatcgagaacaggcgctggtactgcttgatcagcgcgttcttcggctgggtgaggatggtgaccagcgcctcttcgtccagttcctccagcgtggcgaccaccggcaggcggccgatcagctcgggaatcaggccgaagcggatgatgtcctgcggttcgacatccttgaacagcgtactcaggctcttgccgtcgtccttggaggacacttcggcgccgaagccgatgccgcccttctcggagcgttggcgaatgatcttctccaggccgtcgaaagcgccgccgcacacaaacaggatattggtggtatccacctggatgaattcctggttcggatgcttgcggccgccctgcggcggcaccgatgccaccgtgccctcgatcagcttcagcagcgcctgctgcacgccctcgcccgatacgtcgcgggtgatggacgggttttccgacttgcgcgagatcttgtcgatctcatcgatgtagacaatgccgcgctgggccttttccacatcgtagtcgcacttctgcagcagcttctggatgatgtgctcgacatcctcgccgacataccccgcctcagtcagcgtggtggcgtcggcgatgacgaagggcacgtccaagaggcgcgccagcgactgcgccagcagggtcttgccggagccggtggggccgatcaggagaatattgctcttggccagctccacgtcgtccttgccgctcttctggtacagacgcttgtagtggttgtacaccgcaaccgacagggttttcttggcgaaatcctggccgatgatgtactggtccagatccgcgcgaatttcctgcggcgtcggcagcgggcggtcggcggacgcgccgcccaccacttcgctgctgctacccttctccagctcttcgcggatgatgtcgttgcacagctcgacgcattcattgcaaatgaatacctgcgggccggcgatcagccgctgcacttcgtgctggctctttccgcagaaagagcaatagagaagtttctcgttgctgtttttgtcagccattagccaattccactacttacgccgtgacatccttgcgggaagacagcactttatcgatcaggccgtagacacgggcctcttccgccgacatgaagttatcacgctcggtatccgcctccagctgctccatggtcttgccggagtgcttggccatcagctcgttcatcttggctttcaccttgacgagttcgcgggcgtggatttcgatgtcggtcacctggccggacaggccgccgccgtacagcagcggctggtgaatcatcacccggctgttctccagcgcgaaacgcttgccctcggcgcctgccgacagcaggaaggcgcccatgctggccgcttggccaatgcacagggtggaaacgtccggcttgatgaagttcatcgtatcgtagatcgacatgccggcggtgatggagccgcccggcgagttgatgtagaaatggatgtccttgtccggattttccgactccaggaacagcatctgcgcgacaaccaggttggccgattcgtccgagacggggccgaccaggaagacgatgcgctccttcagcagacgcgaatagatgtcataggcgcgctcgccgcgaccgctctgctccaccaccatgggcaccaggcccaacccttgcggttccatcatcgatttcatcggccactcctagaggttgttatcaggcttggctgcccatcagttcgtcgaaggacagcgccttctctactacattggcctgagacagcacaaattcaaccacgttgtcttccagcaccatcgaggtcgggccttccaggcggtcggcgctctcgtagtaccaggccagcacgtcttccggctcttcgtagctgtcggcgaattcgacgatcatcgagcgaacctgttccggcttggcttccagcttgttggcttccaccacttcggacaggatcaggcccagcttgacgcggcgttccgcttgggcggtgaacagctccggcgggaacggcatgtctttgacgttcatgccgcgttgctgcatgtcgcgacgggcctgctcgaccagacggccgatttccaggccgaccagcgccttcggcagttcgatttcggtcacgtcgatcagcgcctgcatcacgttttccttggtgcgggcctgcaggcggcgcttcacttcgcgctcgacgttcttgcggatttcgccgcgcattttttccacgtcgccttcggcgatgcccagcatcttggcgaactcttcgttcacttccggcaggatggcttcggccacgttcttcaccaggatttcgaacacggcggttttgccggccacgtccttgccgtggtaatcagccgggaagctcacttccacgctcttgatgtcgccttctttggcgccgacgatgccggcttcgaattcggccagcatctggccttggcccagcacgaaggggaagttctcggaggagccgccttcgaaggccacgccgtcgatggcgcccttgaagtcgatgatcacgcggtcgccgacggcggcttcgcgctcaacgcggttgtagcgggtgcgctgcttgcgcaggatgtcgatggtcttctcgatttcggcgtcgcccacggtgacggccggcttctcgatttccttgcccgccagctcgccaaccttcacttccgggtacacttcgaaagtggcggcgaacttgaagttttccttgtcgtcgccagcggcaaccggctcgaagcgcgggtagccggcaacgcgcagcttctgctcggtcacggccttgtagaagccttgctgaacctgttcacccataacttcttcacgcacctgggcgccgtagttcatctccacgatcttcagcggcgccttgcccgggcggaaaccttgaatcttggcgctgcgggccacgcgcttcaggcgctcggtgatttgcgaatcaatggcggccatcggcagggcgatgtccatgcggcgttcaagattgctcagtgtttccagctgtacttgcatgttaaatccttcgaagtgtgacaggttgtagtcatctgggacggtacgacgccggacggcgcgctcccgcgggcgggaaagctgccgctcaggcgctgcgcggagttacaccgcgcacccaacgaaacgcacagtatatcacgcacctcgcgcttgtctgcccccgcgcgggccgcccgacccgccagcggcgggcgccgccagcccgcccggaccggccttggcgcccaggcgccgcgccggcctttcgcttgccgtttgatattgctggacaatttcgccgcgccgctcccggcccggccagccatctgctatgattccgcatcatgcgaattgccagccaagacaagaaaaatatccgttcagaatgacacgcccgacagccgactcccgcccgaaacccgatccgcaccatggtgacgccatgaaaacaccgctgcgcccaggcctgatcgccgcctggctgctcctgcccggcctttgcgccgccgccggagtcaccaccttcagcccgcaaggcgaagtgaaggaagtcacccaggtacgcgccaccttcaacagcagcatgatcgcgctgggcaacagcgctgcgccggcgccgttcgcctggagctgcggcttgaagggcaagggccactgggtggacgacaagacctggacgctggacgtgcgcgaaacgccgccggccaatactgattgccgcttcacccccaagcctggcctgaaggacctgcagggcaacgccgtagcatcgggccaaagctaccgcttctacaccggccagcccatcatcgccgcaagctggccttcggatggccgcatcgaagaagaccaggccttcgtgctgcgcttcaacgccagcggcgtcaagcccgcggcgctgtattgccagtcgtccagcctgcccgagcgcattccggtgcgaacgctggccgcggccgaccgcgccgcgctgctcaaacacctgaaactggaaaaacaggccgccaacgtgctgaccgtgcgctgcgaccagcgcctggcgccggacagcaagctgacgctggtgcacctgcgcggcgccagcgcgccggacaagcagcaataccaggtgcggccggcctttgccgccagcatgagctgccagcgcgaaaacgccaaaggcgcctgcattccgttcaagccgatcacgctgaatttcagctcgccggtgccggccaagctggcccaggcgatccggctgtccggcggcggcgccgagcgcgcgccgcaagcggagcagcgcaacaagggcgagccggtggacaacgtcagcttcgcaccgcccttcccgccgctggcaaccctgaccctcgcgctgcccaaggacttccgcgacgaagtgggccggcagccggtcaacgccggccgcttcccgctgtcgatcaaactggccgactacccgccgctggccaagttcgcggccgcgccgttcggcatcatcgaatccggcgccgacgccgccctgcccatcacgctgcgcagcgtggagggcgacctcaacatcaagtcggtgcaactgggcgggcaggcgctgcgcctcagccgcgacgccgacatgatggcctggctggccaaggtggaacgctaccatgagagcaatctgccggccggcaaggacaagacggtggaaagccggcgcgtgtcgctgctgaacaagaaccgcgacgccgtgccgctcaagctgccggccaagcccgacggcaacggcaagtggccgttcgaggtggtgggcatcccgctgcccaagccgggcctctacgtggtggaggtgtcgtcccggctgctgggcaaatcgctgctggccgccaacaagccgatgtacgtgcgcaccgccgcgctggtcaccaacctggcggtgcatctgaaaaaatccggcgaaaacgccgcggtctgggtcaccacgctggacaagggcaagccggtgcccaatgcccgcatcaacatctacgactgcaagggcaacgcgctatggagcggcacaacaaacgcccagggcagcgcgctggccaagagcgcgctgccggccggcgattgctccgacgaagaactgtccggcctgttcgtcaccgcccgcgccaaggacgcgcagggcaacgaagacgtgtccttcgtccgctccagctggaaccgcggcatagagtcctggcgcttccccttcccgacccagggcggcgacggcccggccatcatcgcccacagcatcctggaccgcgcgctgttccgcgccggcgaaacggtgtcgatgaagcacctgctgcgggtgcaggccggcaagggcctggcgcagctgaaacccggccagctgccgcagcagctgcgcatcgtccacgacggcagcggcgacgaagtcagcctgccgctgacctggcgcaagggccgctacgccgaaagcagctacgcgctgcccaaggaggccaagctgggcgaatacacgctgtatctggaacgcaagggcactcgcggcccggccgaccaaggcaagccgtccagcccggagctggacggctactcgctgcaaagcggcagcttccgggtggaggaattccgcctgccggcgatgaccggccgcatcgccaccgccaagaacgccggcatcgccccggcgcaggtgccgctcaatgtttcgctgtcctggggcaacggcggaccggccaaaggctggccggtggaagtcagcgccatgctggccgacggctaccagcggctgaaagcctacgacgacttcagcttctcgccgccgcagcgcagccgcgaaaacagcgaggcctcgctggacggcaaggtggtgctggacaaagccgccatccagctggacggcaacggcaacggcaaggccatcgtcgacaagctgcccaagctggaccgccgctacgacctggtgaccgaagccgcctaccgcgatcccaacggcgaaacccagaccctcacccgccgcatcgcgctgtggccgtccgccgtgcaggtgggcatcagcgtggacagctggatcaccgccggccgcgccttgcagatgaaagccgtggcgctggacaccgccggcaagccgctggcgggcaaggacatcaaggtcaccctgcgcgagcatcgctacctgtccagccgcaaacggctggtgggcggcttttacgcctgggaccacaacgaggaaaccgacgacaagggcaaggtgtgcagcggcaccaccgacggccgcggcctgatctactgcgagctgagtctgaaagacgccggcgacatggagctgatcgccgaagccaaagatgagcaaggcaacgtcgcccgcagctcgcaatcggtatgggtcagccagcacgacgagctgtggttcgatgtcgacaacaacgaccgcatcgacgtgctgccggaaaaaaccagctacgcgcctggggaaaccgcccgcttccaggtgcgcatgcccttccgcaaagccaccgcctgggtggcgatagaacgcgaaggcatcctggaaacccgcgtggtggaactggaaggcaagaacccgtcgatcgaactgaagatcgcgccggactggacgccgaatgtctatgtttcggtgctggccgtgcgcggccgcatccgcgacgtgccctggtattccttcttcacctggggctggaagagcccgtcggaatggtgggacgcctactggaacgaaggcggcgactacgcgccgccgaccgcgatggtggacctgtcgcgcccggcgttcaaatacggcatcgccgaaatccaggtcggcgacgccgccaagcgcctgagcgtggaagtgacgccggccaaaaaaacttatggcatccgcgaaaccgccgacgtcgccatcaaggtgaagctgcccaacggcaagccggcgccggccggcaccgaagtggctttcgccgcggtggacgaggcgctgctggagctgcagcccaatcacagctgggagctgatgcaggcgatgtaccagcggcacagctacggcgtggaaaccgccaccgcccagctggaagtcgtgggcaagcgccactacggccgcaaatcgctgccgccgggcggcggcggcggcaaggcgccgacccgcgagctgctggataccctgcttacctggcagccccgggtgacgctggacgccaacggcagcgcccgcgtcaaggtgccgatcaacgacgccctcacccgcttccgcttggtggcggtggccgatctcggcaatgaccagttcggcaccggcgaagccggcttcaatgtgacgcaagacctgcagctgacgtccggcatcccgccgctggcgcgcgaaggcgaccagttccaggccggcgtcaccgtgcgcaacggcggcgacaagacgctgaacatcaaggtgcaagccggcgcgccgggcctgccggcgctgcccgcgcgccagctcgcgctgccggtgggcgaatcgcggctggtgagctggccggtgaccgtgcccagcgacatcaaggagctgaagtggacgttcagcgcccagcaagtggacggcaaggccgccgacaagctggcgatcagccagcggatcgacccggcggtgccggtgacggtggaacaggccacgctgcaacgggtatcgcctgagctgtccatcccggtggcgctgccgccgggcgcgctgcctggccgcggcggcatccgcgtcagcctgcaggccaagctcggcaacagcctgcccggcgtgcgccgctggttcgaggactacccctacgcctgcctggagcagcgcagctcgatcgcgctcggcctgtccgaccgcaagcgctgggatcagctgatgagcgagctgccgctgtatctggacggcaacggcctcgccgcctacttcccgctgggcgaaggcgcgccggaccgcggcagcgacgtgctgaccagctatctgctggccgtcgccggcgaagccggcatggaaatcccggaaagtccgcgcggcaagatgctggacggcctgtccgccttcgtcgagggccgcctcaaacgcgatctgcctatcaaccgccaggacgccgacgcgcgccgcctggccgcgatggacgcgctgtcgcgctacggccgcttccgcccggccatgctggacgtgctggacctcaatccgcagaagatgagcacttcgatgctggcggactggctgtcgctgctgaaccgcgcggccgacatcccgcaacgcgccgcccgcatcagcgaagcgtccaacctgctgcgcgcccgcctgacctaccagggcacccggatgggtttcagcaccgagtccggcgacaacgcctggtggctgatgggcaacggcgacgtcaacgccgccaagctgctgctggccgtccgcaagctgcccgactggcaggccgacatgccgcgcctgctgaccggcctgctcgcccgccagcaacgcggccactgggacaccaccaccgccaatatgtggggctcgctggcggtggcgcagttctcccggcagtttgagaacgcgccggtgagcggccagacccgcgcgctgctcggcaaatccagcctcagcctcgcctggccgcaggaaggcgtcaaacagctgggcctgctgccgtggccggctggcggggccagcctgcagctcaagcacgccggctccggcgcgccgtgggccaccatccaggcggaagccgccatcccgctgaaaaccgcgcgctacgccggctacagcatcaagaagacgctgacgccggtcagccagaaggtgggcggccagtaccagcccggcgacgtggtcaaggtgacgctggaaatccgcgcgcagaacgacatgagctgggtggtggtggacgacccgatcccggccggcgcggcgattcagggcagcggcctgggccgcgactccgccatcgacgccaagtccggcaacggcggcgactacgccgactacatcgagcgccgcttcgccggctaccgcgcctactacagctacgtgccacgcggcgagttcaaggtggaatacacgatgcgtttgaacaatcccggcgccttcaagctgccacccacccgggtggaggcgatgtacgcgccggaggtgttcggcatggcgccgaacggggtgttccgggtgatggacggacaatgacgcgaacggtccctcttcgcaatcgaagaggggcctgtttcattatgacgccgatccggtcgctatgccgcgcggttcgcgtggtagaaaatcagaggcgaggcccaagccctccactctgcaaaccactaccgcatccgacatggccatggacatcgaacagatcaaaaccctgctggccaaacccatcgccaaactgaccgccggcggctttcgccccacttatcaggaaacggaaagttggctgggcaaggtgtcactatttgcgcctggcgaagccattccgctcgacgatgcgggcaagccgatgctgccgctagcccagctttgcattccggctctgcctgtcatctcgccgcggcttgccgataccaggcttttgacggtattcatttccgccacgctgccagaaccattcgaagcgatgggggccaactggctcgtcagggaatatgggcatggcgatttgctgatccgccaggatttcctgcctcagggccccagcctgaaagcctttccgctgcaagcggagcgcatcgacgaggactatccgctatgggacagcggcgacattcccctggagctggagagtgagatcctccgccaggaaagagccggcaagatcgctggctattacgatttgacctgccacacctatacacacaaaattggcggttatccttcttattaccagtcgggcgtgggtcttggcgaaggttttgaatttgttttccagattgcgtccgactccaaaatccatctcaacatcatcgacaacggctgcctgatgttctggaagcacaaaaccactggccaatgggctctctactacgatttttattgaggcacgcgcctgacgctccgccccgcgaaaccacaccatgccgctgaacgactcatcccatcacattgcaccggccaggaagctcgcgccggccccctcggctcgccgccggccaaagctgtcgctcgtcctgctcgccctcctctccgcccccgtctgcgcgcagcccaccttcaaggaagtgaaagccgcctggcagccgtccgacgtgacgctgctggaccgccacggccaggtgctgcagcggctgagggtggacaaacaggcgcggcggcaggattgggttggcctggccgacacctcgcccgccttccgccaggcgctggtgctgtccgaggacaaacgcttctaccagcacagcggagtggactggtccggcgcggccgcggcggcctgggccaacttgtggaacacccgcacccgcggcgcgtccacgctgaccatgcagctggccggcctgctggacgatgatctgaaagccggcaagggcgggcgcagtctatggcagaagatggggcagacctggtccgccgcctggctggagcggcactggagcaaggcggagattctggaggcctatctcaatctggtggggttccgcggcgaattggtggggctgtcctcgttgtcgtccacattattcggcaaattgccggcggggctgaatctggaagagtcggcgatcgcggtggctttgatccgcgcgcccaatgccgcgccggacaaggtggcgggccgcgcctgccgcattttgcaggacatgggccgcaagcccgactgcggcgtcgtcgccgtccacaccgcgcaggcgctggccaaaagccgcgccgccaacccgctggccgaacaggacgcgccgcacttcgcgcaaaagctgctgcaaaggcaaaagctggcggccggcagccgggtggccaccacgctggacctgccgttgcagcgctatgccagcgccgcgctgcgccgccatctggccgcgctgtcgcaacgcaatgtccaggacggcgcgctggtggtgctggacaaccagagcggcgacatcctggcctgggtgggttccagcggccgcggcctgtccaatgccgcccaggtggacggcgtcacctcgctgcgccaggccggctcctcgctcaaaccctttctttaccagatggcgctgcaacagcgctacctgaccgccgcctcgctgctggacgacagcccgctggacctgcaaaccggcgccggactctatgcgccgcaaaactactcgaaagatttcaagggcctggtgccggtacgcaccgcgctggcgtcgtcattgaacatcccggcggtgcggacgatagaaatggtcacccccaacgccttccgcgaccggctggtccagctgggcttcgccagcctgaccgaagacggcgactattacggctacagcctggcgctgggcgcggccgacatccgcctgctggatctggccaacgcctatcgcacgctggccaaccagggcctggccagcccgccgcgctggacgctggccgacgccaaagcgaagccgactcggctgctggatgcggccagcagcttcatcatcgccgacatcctgtccgaccgcaccgcgcgcgcgctcaccttcgggctggaaagcgcgctgtccacccgttactggagcgcggtgaagaccggcaccagcaaggatatgcgcgacaactgggcggtgggcttctcgcgccgctacacggtggcggcctgggtgggcaacgccggcggcgagccgatgtgggacgtgtccggcatgcatggcgcggcgccgatgtggcagacggtgctggatcgcgcccagcaatcggcgccgccatcgcagcctccggcgccgccgcccggtctggcacgccagcgcgtgcgttaccagggcgatgtggccgcgccgcgcaccgagtggttcctggccggcacccagcgcgcgctgatcgtgccgcaaaagggctccgccgccgacctgacgccgggcatcgccgcgccggtggacggcagcatcttcgcgctcgacccggacattccgccggccaaccagcgcatggtgctgcgcgcgcgcggcgtcgccaagccgcagtggtggctggatggcaagaagctgggcaatggcgcggagctggcctggtttccctggccgggccggcatcggctggagttgcgcgccggcgacggcaagagcgtggagaaggtgaagttcgaggtgcgcggcgccgcggcgaagcctaagccgcgctgaagagccgcgcatgccgccctatgccggtttgcgccgcgcgagcgattgcatcagctgatccgcccgttgcgccgcgccggccttctgctgatcggtcagcgcctggtagtccttggtcttcaggaaccagtcggcgctgagcgcatcgcctgaacggcgcgccacctggttccaggccgcggcctccagcggctgtttttccagcagatagctctccgaaatcatcgccgccgcatgcatattgcccagcgcgtaggcctgctgcagcgcctcgcgcgcttcgtcgcggtagcggaagccagcctcgtagccgggctcgcccggatggccgtccagctggaacaggtagcgctcggccagatgcgtcaaggcctgcacgttgccttgcttcgccagctcgcgcagttgcgccagcgacatctggtaatagcgcgcctcgatctggtagccaagcttgcgcaactgctgcttgcgctggcgctcggccggcgtttccggcggcggcgccgcctggccttggacagcgggattgccgcccaccgcgaagctgaagccgtcagccggcgccgcggccgccaccgcccgtcccgccgccgggccggaagtcggttgcgacgcatgcgtcgccccggccgccggcccctgcgcgcggggcccccatagccagcccgccgccaccgccgtcccaacggcggcgacgagcaacaagggtgcgcccctcatgtcagatccggttcaggcaagtgttgaggccgttggcgtagccgtagcgcgagtagtagtcgcgttgcgacggcgtgccgtgctcggcgtagtcggccgcgtcgcgggcggaggccaccgcgttttcgatgaagcttgggtagcgcagattggtctcggcgtacttggcgaaggtgccgcccacgcagtccgcctgcagctcttgcatcggcggctggcggttgatgccgcgggtgaactggatggtgtggccccattcgtgcgccaggatgaacttggccacgtagttgccgtagctgctttcctgctgctgcaggaagccgacgccgacgctgatggtgtacggaccgcaagccatcgcgctggcctggccttcgccgcaggccgactggtcgacatacaccgtcgggcgggagtacgagccgagctggccgcggatctcattggcgctggactggatgtaggcgttgctgaccggcatggccagcgcgccggccgcctgtcccgcgatcgccactgccagggctgccgcgttgaagattttccttgtcatgatctctttctccttgggttgttacatcagggagatttgtttatgcgatataaataaatcattttgaaagaattattttgcctaaaaattcaattcaatatgctcgttatatgtcaatgtattatttacatcaagatcagacaatctctgcagatactgaataaaaaaagggcggcccattgccgccccttttccgtcaagccgatccggactcaggccgcctgcccggtcgccgccagcacgatctcgcggatgcatacccgctgcggctggccataggcgtaggcgatggcctcggccacgtcctgcgcctccagcacgccgccaatgccctgcttccactcctggtagcctgccttgatcgcctcgtcggtggtgtggcccaaaagctcggtctccaccgcgcccggggcaatggtgatcacccgcacgccgctgcccgccacctcctcgcgcaaattctccgaaatggcgtgcacggcgaacttggtgccgcaataggccgcgtggctgggaaaggttttccgcccggcgatcgagctgatgttgatgatgctgccgcggccgcgcgcctgcatgccggccagcaccgcgtggatgccgttgagcaggcccttgacgttgacgtccagcatcgcctgccattcgtccgggtcctgccgcgccagcgcgcccagcagcatcacgccggcgttgttgacgatggcgtcggccggaccgaagcgggcctccgcctcggccaccgccgccagcatcgcggcgcgatcggtcacgtccacctgccggcacagggtgtccggcaaatccagggcctgcaggcggtcgatgcggcgcgccagcaacagcagcgggtggccttgctgggaaaacagtttggcggcggcggcgccgatgccggaactggcgccggtgatcacgatcagggctttagtcataattgggctctccatagaaaaatacgatgtgtttttgatggctggagtatattcatcgcagtgcggctctgaaaaatgataaaaatctctacctggcatcgaaattttctatggatatccgtcaactaaaggccttcatcgcggttttcgaggaacgcagcatcacgctggccgcccagcggctgttcgtcacccagccaacgctgtcggtcaccatccgccaattggaagaggcgctgggcgcgcagctgttcgaacggctgccgcgcggcgtggaggtcagcgaggaagcccggctgctgtatccgcaggccaggcggctggtggcccaggccgaggcgctggcgcggatgttccgccagccgcacgattgcctgccgctgaccctgggcgtggacgcagatgtcggccccgggcagctggaagcatttctcgccatggccgcgcgggcctcgccggccattctgctcagcgtggaggaaggctgcgtcggcgacgccaggctggcggcggaggacagccgctgcgaggacgagctgtttgtcccgctatgggaggaaagttttgtgctggcggttacggccagacatgcgctggcggaacggcggcaggtggagatgagcgaactggccggcgccgactgggtcacctgcccggcgcacgcgtcgcatcagcgcctgctggatctgcatggcgcggtggcgccggaactggcgctggcggcacaggccggcagcctgcggctggccgcgcgcatggcggcggcgggactgggcttggcattgctgccggcctcactgctggcgggcgcggacgggcttgcgcccattccgctggccggcgccacgttgacgcgccgcgtcggcctgtgccacgcggcgcaggcgcaggagcttcccgcgctacaggcgctgctggcttgcctgccggcccaggatcacagcggcagcggcgcggacaagccgtagttgccgatcagcatcgccgcggtgaacagcatcaccagaccgatcacgcaatccagcaccttccagctggatggtttctggaacagcggcgccagcttgccggcgaacagcccgatggcgccgaaccacagcaccgacgcgcacaggctgcccagcaggaaggacagcgcgccgtgctcgccgtacaccgaggacacgccgcctatcagcaccacggtatccagccagacatagggattgagcaacgtaaccgccaaaatggtgcggatggcgcgcttgcggtcgcgctccacgctgccctccagcgacatcgcgccggcggaaaaggcggagcggaaggatttgaagcccagccacaggatgaaagccgcgccgccccaggcgaccacgccgacaaaaccgggaatgccggccaccaccttgcccatgcccagcacgccgctggcgatcagcagaatgtcggccacgatgcaaatcaggatgatgggcaccacatggctgcgaccgatgccctggcgcagcacgtaagcgttctgcgggccgatgcccacgatctggctgaaggaaatgcccagtgcggaaagaaatacgctgaagttgaacacagtctgctccaaaattattctattacagactacctgcgcattttcattcagtaaaactaataaaaatcatgatacataagaattattaatatctgccgtcgcacccttgcgcagccaatttcgggtccacgccggcaactcggcggcggccagcggcggcgaaatgccgtaaccctggccgtcatggcagcctatctccagcaagcggctccagatggcgcggctttccaccccctccaccaccagcttgcgcccggtatagtgggcgaaggacaccatgctgcggatgatggcttcgttgcccggcatttccagcaacaagcgcacgaaacgctgatcgatcttgatggtgtcgaatggcaactgctgcagatgcaccagcgacgaggcgccggtgccgaaatcgtccagcgcgatcgacaggcccaggtcgcggcagcgctccagcttggaagtgatctgctccgcctcctgctgggtgacgctttccagcacctccaactccaggaagccggccggcagcggattggcctccaacagcgcttccagcgtgcgcaggaaatcgtcgtgcttgatggtggcggcggacaggttgacgctcaccggcatcggcagcccctgctggcgccactcgcaagcctggcgcaccgcttcgcgcagcacccaccagtccagctcgcgcatctgatcggtgttttctatcgctgggaagaactcccccggcgcgatcagctggccgtcgcgcgtccagcgcaccaacgcctcggcgccttctatccggtggttttgcagattgatcttgggctggtagtaaagcatcagctcgccgcgcgctatcgccagcgcgaaagcgctgcgcagcgcgtgcagcttgtggatttcctcatccatcgccgcgtcgtaatggcggaaatggccgccgccctgggccttggcccgggtcagcgccaagtcggcgcgccgcaacaacgcggcggcgtcgcaagggcctgggctgctcaccgctgcgccgacgctgcagcgcatttccactgccacccccatcgcgtccaccggccgcggcaggctctgcagcacggcatccgccagcgattgcagctgatcgatccgctccgagcacgcgatgaagcgcgacgcgcccaccctgccgacgtagccgaacggatagatggcctggcgcagccgccgcgccatctcgcacagcaccgcgtcgccgccgtcatagcccagcctggcgttgatgtcgtggaaaccctccaccgcgatggccatcaccgccacttgcccgtcgttgaagcgggcttgcagcagcctggcgatcaactcctgcatctggctgcggttgggcaggccggtcagcgcgtcgtggcgggccaggaaagccagttcggtttcggcgcggtggctgcgctccagcgcgtccagccgctccagcgcgcggcctatctcgcgcgccatcacatcgaacagcgccagtttcgcttggtcgaaataagcggtctcgcgcgaatacagcgacaaggtgcccaccacttcgccgcggaccagcaaaggcgccaccagcaagctgttgatgccgtggcggcgcaattccgactgccagggctgcagcgaggcgtcgcgcctggcgtggttcaccacctggaccacccggctgcggatggcgcggccactggggccgagtccatatggattgtcggggtcgcccgagacattcggggcattggtcagcggcgtcatgccgcaattggacagcgccgccacctggacatggcggcgggtcggatccagcatgccgatccaggccatgccgaacttggcttcgcgcacgcagacgtcgcatacggcctgcagcaaggcgcgccggtccgggctttccgccagcgcgagactgacgccgctgagggtggcgtacaggctggacattgtctggaagtgcccgcgccgccgcgcggcctcgccatgcaggaagcgctggtagccgtggattttcagcatctggtccagtaggatgcgcttgcgcagcaggcgggagagcgcctcttggccggcggcgccgggcaaggccgccaggctcgccagcaggtgcgtctggcaacgctcgtacaggccaaacagccagcccaggctcacgcccaactggcaatacagctcgccctgctcggccagcttgcgcgcgccgccttcgtccagcgggtcgcgcagcaaagcctcccactcccgcagcaggcgcgccgccagggcttccatcgcctcgccgtagtgccgctgcaacggctcagcctcctgcggactcttcagcaaatgccagtacagctccttggccagcagttcgctcctcgccagacaggcgtcggcctgaagcgacaacgcggccaggtgttcggtccggatcccgataaagcggcacatgcctgccaggagcgccatattatccgtctgcatcttgttttctgcgcctgtcgtggccagggcgcgctcctgccggcacgcgccctccttgctgtcttgcccgcctgcccgaaagcaggcgattattgtcggcgcaagcgccttgcgccgaagcctgccaaaatgccacggcgctggcttttaagcaagtccacgggcattattaaccagataattattttttagcggcattggaaagcgtttcgtgcttgatccccgacaattgcagactctggccgcggtggcggaaaccggcggcttcgacaaggcggcgaaaaagctgtttctgacccagtcggccgtatcccagcgcatacgccagctggaagaacagcttggccaaccggtgctgacccgcacctcgccggccgagcccaccgaggccgggcgacagctgttgcagcaccatcagcagctgatgttgatggaaaaccagctgttgaggcagctgagcccggcgccgcggcagcgcgaattcaccacgctggcggtgggcgtcaacgccgacagcctggccacctggtatctgcaggcggtggcgcctgcgctggaagaaaacgacctgctgctggacatcgtggtggacgaccaggaccacactcacgaactgatgcgcaccggccatgtgataggctgcgtcagcacccggccggtgccgatccagagcggcatccagcactatctgggcgccatgcgctaccgctgcctggccacgccggccttcgccgaacgccactttccggacggcgtcagccatgccgcgctggcgcgcgcgcccagcatcatcttcagccgcaaggacgccgtgcacgggcaattcctgctgcaggccgccggctaccagggccatttcccctgcatgacggtgcccaccgcccaaggcttcgtcgagctgacccgccaggggctggcgtattgcctgctgccggagctgatgctggacgacgacctggccagcggacggctggtggacctgtttcccggccaatggctggacatcccgctttactggcaccactggcgggtggagtcgcggctgtcgcaggcgttgaccgaagcgatgctggcctattgcggccgccacttgcgccaggacaaggacgccgcccccgccgccggcggagaatgccgctgacaacgctcgacaggcgccggattgacaaggcaagggtcctggcgcatcatccgtcgccgacctggttttatggaggcagcatgaccagcaatcaacaagcacccagcaaggcacaatgggccgaactggaaaccgccgcccggcaggcggccagccaagcctacgcgccatacagcaagttttccgtcggcgccgccattctcgacggcgccggcaagatccacatcggctgcaatgtggaaaacgcctcatacagcctgggcaactgcgcggaacgcaccgcggtgtactcggcccgcgtcaaccacggcatgcgcgaggtggtggcggtctgcatctacactcccaccgcgacgcccaccccgccctgcggcgcctgccgccaggtgctgaatgagttcgggccgacgatgcgggtacgcgcgatctgcgacggcggcgacgtgatagacgccacgctggacgcgctgctgcccggagcctttggccctaaaaatctgcaggacgccgccggctgaagcgccgccccgtccttgcccgccacgccagcggaagcctagcgcttccgctttctttttgtccgcgccggctcaaaccgcctcgcggcggcgcaccagccccaagtcctgcgccgtcggcagccaagcggcggcccgggcgcgcagccaggccgcctctacgccggcttgctcggccgcctcggacaaagccttttcgccgccgcccagccgcgccatagcctgcaacaactcgaattgccacggctccagctcgtgcgcgctcactcgccattgccgccgcgccagcgccaagcgcccttccgccaatgccggcaccgccagtcgctgtccgcgctgcagctcatgccagcaggccaggagcggcagactggttttcagcagccgcacgctgtccggcagcgccatgccggccaacggactctccgcgcccagcaggaccagccagtcgtcgaatggcggcggcgacgcgccctccacgccttccgcccggcctatctcggcatgggcccgctccagccgcgccagctccaccggcagccggcactccgccgcgtccgggtctggctggctggccgccagaaaatcggcgaaatccgcgcccaagtcatgcagcgacggcgagcgcgatggccgcgacgcgatgtagccgcgcgccagcaggtcgaacaagggctggcccagcaagacgagcagcatcggatagtcggcgcgcaggcactccagcagccgcgcccaatagccatgctgatatacgccgatgcgatcgcgccgcttgccgcgcggcggctcggccaccaggtcttcgcccagcccgcagcgggaccgcgccagcgccaggccctgctccagcgcgccgccggccgtcatcgccgtcagcagccacgtctggctgtcaagcaaggcaggccggctcatggctttcctttcctcccggcagcgcctgcggcgcgtattcggccagcaagcgcctggccttgtccaattctgccagcagctccggatacggcggaatgtcggcatcccactccagcagcgtgctgacgccgccgcaaagccgctgcgccaagaggtagagctgccagacgcgctccggcaccggatggtcgtgggtatcgatcaggcaatcgccgcagtcgctcggccctgccaggtggatttgcacgatatggtcggccggcagctggcggatatagtgctccggatcgaagccgtggttgtagccggaaacgtagacgttgttgacgtccagcagcaggccgcagccgcatgcctcggccagccgggacaaaaacgcccattccggcatcgtggagtgggaaaactgcagatagctgctgggattttccagcaccagcgggcggcccaaaaagtcctggacctgcagcacgcggtcccgcacatggcgatagctttcctcggtcaacggcatcggcagcaggtcgtgggaattgaccgacgccacgccggtccagcacaggtggtcggacaaccacgccggccgcaactcatcggccagccggcgcagttgttccagatagccccggttcagcgggtcgctgccgcctatcgacagcgacaccccatgcatgacgatgggaacctgctgccgcagctggtccagcatgtgccgggcgtagccgcggtggccgatgaagttctcgctgatgatctcgaaccagtcgacgccggcgccgtgctcggcaaggtgctggaaatgcacattgcgcaagccgacgccgaagcccaggttcggcaaacccaaacggggcaaggtcacatcgcgctccttttcaggtcgagggcggcagggccacccgcagcggcgtaggcgtcggcggatcgccggcaggtttgccgccgctggcggccatcacttcgcgataggcttgccaggccttgtcgtataccgattcgccgacggcgaaatccagcgtcttcggcaacggctcgctggcatgcatcggtccgacgaatttgtacagcagcatcgtgccctggctagggaacaattgcgacgccgaaatcggcaccgcgcagccgccgaagctggcgcacttgttgtcgcttggcgcgctgaaggcatccgtgggcggggttggctccggcggcatgcagcactgcgcgccggcggccgcgttcaaattcggcgcggcgcggcgcatcgccgaacaggagccgccgcccttgtcgctctgcacaaagccgcagccgccttccgccttgcagctgttggagccgcggcaggtgtggtaaacctcgatcgccgcgcaggtttccccgcttgagccgtccagattcatgccctggcatgcgtggtacagcttgccggcttcgcgctgcccgacgcccagcgccagattgggcgccttgcccaaagccgcccagcacaaggaaacgcggtcgcccgaacccaccatggaaggatatggaaaagtggtctgctgcttctgccagtaggtgttcaacaccgtggtgacgccggcgatggcgcccgccgatacgaagctcagcacccggaacatcgacgggtcctgcttcagcgtgttcagcgcgtcggccacttggctcggagacgggatgttcttcggcgcgatggccgggtcgtacgccggatttttcagcatgtccgccgtccagcgattgcctttggcatgccattgctcccaggtttccacctgccgcagcaacgcgtacagttcggcgaaacgctcgtagtgggtccaggcggcgctgtcgcagcgcgcggcggcatcggccgacggcaccggcttgccggcgccgtcgtaggacggatagtccacctccagcgccttgcggtcctcgcggtagggctccttcacttcttgcagcatgccgccgcggcgatagcgactgaggctagtctgcgcgccctcgccctgatcggtgatggccgccatcatgtcgatggccttgttgaacgagcgatctttgccgctgaagtcttccgggacgaacagcgtcgacagctgcggaaattcccgcatcgggtggccgccgccctgggcattgaacaaatcctgctgtaccgaattcgcccctgccgtcacccctggctggtctgcgctggtcaggtagtcccacagcgacttgccgctggcgtattcgatgctgacatattgggccaagcactcgtacatccagcctatggtgccgaacagcggcaggttctgcacccccatgtccggcttccagccggcgaaaggcactttcgggaaatacttggcctgcaccggcggcggctgcctggccagctcggcccgcgccgcgccttccggctgctcgatagcgcggaacaattcgatctggttttcgttcaaggcctccagattgacccgcaccttgttgtaggtgctggtatcgcgcaggtcgatgatatgcggcagcatcgactgctgcggcccgtagcagatccagcccagccgctggtccaccagtcccggcggcgtgaagtcgggctgcacgcccatcgccgtggccaggttggccgccatctgcagatgcagcatttcctggatgaacacgctgaaaatgacattgaacgcgcgctcgttgctgttgcgcggctggctgacgggcgcggagcccggccattggcggccgcgataataatccaggttcttgctgttgatctggtgggtgccctgaatggagtacatggtggtcatgtacagcgggatggtgaacaactccacgctgaccgcagcctgaatgatggcgcgggccgccgacttgtcgctttccaactcgttcaggctgcgatcggtgattcgattcaaactggcgccgagaacaggaatttccatctcatcctcctaaaaagcgcgcgaggcgcaaggctggggtgctgccttataaccttaggagtccggatgcacggagaaagcgcatatgagcgggactaagaaatagtacttatgagcggccgtgaaaaacccgccggcaaaccggcgggtttcagaggcttcgcggcggcaaactgcctcagcggcctgccaggatcgcctgcgcgaccgcctcggcgatcttgatgccgtccacgccggccgacaagatgccgccggcgtaaccggcgccctcgcccgccgggaacaggcctttgatgttcaggctctgcaggtcttcgccgcgggtgatgcgcagcggcgagctggtgcgggtttctagtccggtcagcaccgcgtcgttgaggtcgtagccgcggatctggcgcgcgaaatgcggaatcgcctcgcgcatcgcctccacgcagaagtccggcaggatgcgcgcgaggtcggtcatggtcacgcccggcttgtacgacggctccacctcgcccagcttggtggacgccttgccggccatgaagtcgcccagcaattgcgccggggcgaagtagtcgccgccgcccagctcatacgccttgctttccagttcgcgctggaaatccaggcccgccagcgggccgcccgggtagtccacctccggcgaaatgctgaccacgaagccggagttggcgttgcgctcgttgcgcgagtactggctcatgccgttggtgaccacgcgcttctcttccgaagtggccgccaccacggtgccgcccgggcacatgcagaagctgtagaccgctcgtccattgctggcgtggtgcaccaacttgtagtccgccgcgcccagaatcgggtggccggcgtacttgccccagcgcgccgcgtcgatcagcgattgcggatgctcgatgcgcacgccgatggagaacggcttggcttccatataaacgccgcgctgttccagcatctggaaagtgtcgcgcgcgctgtggcccagcgccagcaccacgtgatcgctgaaaatctcgccgccgtcggccaacttcacgccgcgcacgcggtcgccatccaggatcagatcgtccacccgctgctcaaagcggatctcgccgcccagcgcgatgatttcggcacgcatattctccaccatggaaaccagacggaaggtgccgatgtgcgggcgggccaagtagaggatttcctccggcgcgccggccttgacgaattcggtcagcaccttgcggcccagatggcgggggtctttgatctggctgtacagcttgccgtcggagaaggtgccggcgccgccttcgccgtattgcacgttggattcggtattgagttcgctcttgcgccacaggccccaggtgtccttggtgcgctgacgcacttccttgccgcgctccagcacaatgggcttgaagcccatctgggccaggatcagcgcggcgaaaatgccgcagggaccgaagccgaccaccagcgggcgctgtttcagctcggccggcgcctggccggcatagtagtaatcggtgtccggggtgggcatcacccggcggtcgcccttgaagcgggagaacagtttgtcttcatcgaccgcatcgacgtcgatgatgtaaaccaggctcatcacgcccttgcgcgcgtcgtagctgcgcttgaacacggtaaagccgcgaacgtcaccggccgcgatcttcaaaaagccggcaacggcagccgccaactcctccggggagtgatccagcggcagtttcagttcggaaatacgcaacataaaaaatccagtaccaggttggtgtctattcaacgaggcgccattgtaacggcaaaccgcccagcgagcacggccatggcccagcctgcgattgcaattcacccgcgccttggctatagcgtactgtggctccatgtgggccgcggcgccgcatgccttgcgcctgcggcatccccgtttgccgccggcgcggtgacgtggccatccaagccgcacggctccagacagtgccggctggacatcaagttgcaagtgatcggaccgctgcgattttgccgcgcccgccgcggcggcaacaaggcgacatcgccatgcgcgcggcctttgccagaaaggtcaaggcgagcgggaagttttgcaccaaggagaacctcatggatctggacatgctcacccagccggtggtgcggctggcgatagaagcgttgcagcaaggcaacgaaatcatttggctggagcaattcgtccccgacgcgaccctaaccgacgacggcctgcccgccaacttccacaaattcagcgaacatgccatgggccacgagcgcttcacccgcatcgaccgcgtggaaaaccaggggctggacatctacggcgccttccacagcgaccgctggggcgacttcgacgcctgtttcaagttccgcctcgacgccaacggcaagatctgtcaattggacataggccaggcagcctgacctctctccctcggcggactcccgcgcaatgcccgctataatgcagagcgcgcgcttgcaaccggacgcttccgccgaggagaggcaatgcaccagatactgatcgtggatgacgatgccgtatctcagcaattcctgctgatggtgttgcgccggctcggccatgacaatatcgcggtagccaacgacggcatagacgcgctgatccagctggacgccggcgaccggttgttcgacgtgattttctgcgacctggacatgccgcggatggacggcatcgaattcgtccgccatctgggcgagcgcggctatcaaggcaagctgctgatttccagcggcttcgacgagcgcgtgctcgaatcggtagccgaactcgcgcgcctgtacgacctgtggctggccggcctgctgcccaaacccatcaaccaccagcacctgcaggcgctactgagccagccgccgcctagcatccgccgacccggcaatatcagccacccctcggaagacgatttgcgcaccggcatcgaaaaaggcgagttccgcccctttttccagccgcaagtggaaatggcgtcgggagtggtccgctcagtcgaagtgctggcgcgctggcagcacccccgtctcgggctcaccagcccgctccagttcatcgaactagcggagacttccggcctgatcacggatctcaccaagcgcctgctggacgatgccgcgcagatcgtggccaagctgccgccagatccgccgctccacatgtcgatcaacctgtcgatggcctcgctgagcgaaaccagcttggtcgccgaattcgaggccatcttgcgcaacaatggctttcccatgtcgcggctgacggtggaagtcaccgaaagcggcctgatggccaatccaacccgggcgctggaagtgctgtcgcgcctgcggctgaagggcgccggactgtcgatagacgatttcggcaccggattcgccagcatggaccgtctgtcccgcatcccgttcaccgagctgaaaatagacaaaggcttcgtcatcgacgcgctgcagaaccccaccaatatgtccatcctgcgcgccagcgccgaactggggcgccagctaggcctgaaggtggtggccgagggcgtcgcctctttcgccgaatggcaactatgccgagacctggacgtggaaatggtgcagggctcgtacatttccccgccggtcgatgcggaaagctttcgccgctggctgttgaagcaccagggaagcttcccgctgccgccggccgccgatgccggccccgcttaatccccatcatcaaggagccttaccatgcgtacgctgcgcgttctcctgatatcgatcccgctcctgttttccgccgcgccgcgcgctcaaggcgaagccatgctggagaagcccgccggcaaagtggtgctgaccatcagcggccagatcagcaacaaaaaccacgacaatgacgcggtgttcgacatgtccatgctcggcaagctgccgcaacacaccatcgccacccatacgccatggctgcccggcgtcagccgcttcaccggcccctacctggaggacgtgctcgccttggtcggcgccaggggcaagatgctgaaggccattgccttgaacgactacaagaccgacattccactggaagacgcctcccgcttcaatatcgtgctggccttgctgttgaacggcaaaccgatgccggtgcgcgacaaaggcccgctattcatcgtctatccctacgacagccagccggagctgcgctcggagctctattacagccgctcggcctggcaactgaaaaccctgcaggtggagtaaggcatgtccgtcctcaaacggcagcgcctggattggcggatgctgatcgcgatcggcgccaccttgatctgcgtgttcatcggcgtcgcctatatccagttccgtcaatctgagatgctggccggcgcgctgcgcgaccagaacgacaacgtcacctgggcgtatttccagctggaaaccgaaggactgcgcctgcaagcggcgctgcaaaaggcgcagcgccgccgcgtcgatcccgaggagctgcagcagcgctatgacattttcgtcagccgcgtcggcatcatccgcagcggcctgtatcaaagcctgctgcaggaccagcctgagtatcggacaatgcagccgcggctggaccgcttcatccgccagggcgacgccctgctctcccgccccggcgcgctccaggatccggcggcgctggaaaggctggccagccagttggccagcctcgccgacggcctgcatgacatgtcgcttagcgccaaccaggccatggccgaacgctccgacctgcgcaaccgggcgatggagcagcacatcgccatcggcaactggctgatgggcttcgaatgggcgctggcgctgggcttcggcttcaccgtcatccgccagttgcgccaattggagaagcgccgccagacgctggaaatcctcaccgcgcggctggaggaggcgcgcaagcaagccgaagccggcagcttggccaagagcgtcttcctcgccaatatgagccatgaaatccgcaccccgctcaacggcgtgctgggcatgctgtcgctgctggccagcgaagcccccagcccggtccaggccggctatatccgcaccgcggaagagtccgccaaacacctgctgttgctgctcaacgatgtgctggacgccagcaagctggaatccggcaagctggagctggcgccggtcacctgcaatctcagctacctgctgcggcagctcgccaaactgatgagcgcgcaggcccaggccaagggcctgatgctgagcctggacatggcgaccgcgattccggaatgggtggaggtcgatcccacccggctgcggcagatcctcctcaatttgctgagcaacgccgtcaagttcaccgagcgcggcggcgtcgccatccacgcctcctgcacacctggcgcgcgcgcggaccagtgcaatctgcagctgatcgtcaccgacactggcgtaggcatgagcaaggaaacgctgtcccgactgttcaggcgtttttcacaaggggatagctccaccgcgcgccagtatggcggcagcggcctgggcttggagatctcccagagcctggccgcgctgatgggcggcgagatttcggtcaccagcgtcctggggcaaggcagctgcttccagctgagcctgcccttgaaaatcatccaggcgccgcagttgcctgaagaggcggccagcccgccgctccggctggatgatggctcgccccgccgcgtgctggtggtggatgacaacgaggtcaatcgcaaatacatccaggcgatgctggagcggatgaaccagcagccgacgatggcgggcacgggtccggaagcgctggaaatcgcaagaaagcagccgttcgacctggtgttgatggatttgcacatgccgggcatggacggcatcgagaccagccggcgcctgcgcgaggaggcgctgacgccgcgaatggccatcgtggcgctgactgccgatgccttccccgaaacgcggcaaacgacgctgcgccaagggctggacggctttctggccaaacctgtcgatggcgatcaactgctggcggcgttgcggcggcatttgccgccggccgcgccagtcgctgcgctcgacgatgcgcccgagctcgacgaaaaaaccatcgccggcttcatcgaattgctgtcgcccgccaaataccgcgaactggccacccagtttttctccaaccacgaatccacgctgcggctgctggaagccaaccggcaagcacccgaccgcgaccagttgttccatctggcccacagcctgaagggcggcgccctgaccctgggattctccggcctagcccggcgctgccaggaactggagcaggaagcccagcaggacgtctgcgcgccagagcagatcatcggccagttggcggcgcaattccgcgccacgcgggaggcctgcgtgcggcaaggctatctcgcctgcgccgccggctaacaaggcctcaggcgacgcgcgccaaccggccgccgtcagcctcgggaacctcgaaccgtttccagtcgacgatcatcacctggctgaggccgcagtccagcgccagctgggcttcgatctcttccaatacctggtggcaatggatgacgccattgatggcgacctcggcccgacgcatcacgctgtcgtcggcggtgacaaaccagatgcagtatcggctcatcggctaccctcccgcaaagtgccgcaaaacacaggctcaggaatgtaaatatcggtccaattgccgccagactgcaagttttgcctcgaaggccagggtatgcgcggggctggacgaaggcaaggcgagccaagcctccttgcggccggccagttgcggcgcggctttggcggcggtcgcgccattgaaggccaccgcccgaaggccgggaaggctatccagcaagcggctcagatcgttgcggcggacgtcgcgcagatcggcatccaggctgcccttgcggcttgcctcggccaccacgtcccacaagcctatgcctgccccctgcaacgccgacaacttgtccgggtaaggcagcgcgtgcaactcccgccccagcagcgcgcccaacagccgccagaactggttgcgcggatgcgcgtaatactggctggcagccagcgaagcgtcgcccggcagcgagcccagtatcaacacgcgggtattggcgtcgaccacgggagggaagcagcgtttctgttccactgcgctcagcggagtatccatgctcagaatagctggccctggtggctggccagccaggaccggaccggcccgaaggttttgcggtgttccgccagcacgccatggcgctcgatggcggccagatgctcggcggtgggataccccttgtggcgcgcgaaaccgtactgcgggtgccgcgcgtccagcgccaccagctcggcgtcgcgggcggttttggccagaatcgaggcggcggagatcgccgccaccttggcatcgcccttgacgatggcctcgcccggcaccggcagatgcttgggcacgcggttgccgtctatctgcgccaggtccgggcgcgtcgacaagccttccaccgcgcgggtcatcgccagcatggtggcatgcaggatgttgagcttgtcgatctcttcgacgctggcgctggcgatgcaccaggccagcgcgtcgcgcttgatccaggcggccaatgcgtcgcgcttcgcctcgctcagcaccttggagtcggccagcccggcgatgggcttggccggatccaggatgaccgcggcggcgaacaccgcgccggccagcggcccgcggccggcctcgtcgacgccacaaatcaatggcatcgcgccacctccagcaccgcgcgcgcggcgcgggtggcggtgtcctgacgcaaggccagatgcagctcggtgaacgccttttccatatccgcgcgcgccgcggagtcggtgtacagccgttgcatctcttcggccagcttctgcggggtagcctggccttgcagcagctccggcaccacgaagcgcccgcacaggatattgggcaggccgacataaggcagcttgatcttgcgcttgaccaggcggtaagtgaacgccgacagcttgtagctgatcaccatcggtcgcttggtcagcgccacctccagcgtggcggtgccgctggtcaccaacaccacgtcgctggcgatggtggccatctgcgcgtggccgaacagcttgcggatcggcagatcgcgcgccttgtagcggtacagcatctgctcgaacaggtccagcgtggcgcgggtggccagcggcaccaggaactgggcgtccggatactggcgcagcagcaggcgggcggtgtccaagtataccggcaccatgtattccagctcgctcttgcggctgccgggcatcagcgtgaacaccggcacctgcagcggcacgcccaactgctcacgcatcgcgtccttgtcgggatcaagcgggatttcgctggccagcgggtggccgacataggtcaccggcacgccggcctggcggtacagcggcggctccatcggaaacaggcacagcacgtggttcaccgacttgcctatcttctgcacccgctccggccgccaggcccatactgacgggctgacgtaatgcacggtgggaatgccgcccttcttcaacgcgccttccagcgccaggttgaaatcgggggcgtccacgccgatgaacacatccggcctttccgccaacaggcggtcgcgcagctggcggcggatgcgcagcaactccggcaggcttttgatcacctcggaatagccccgcaccgccagcttttcctgcggcaccatgctgtgaaagccgcgggcttccattctggggccgccgatgccggcgaattcgatatcgctgcgatgggcgcgcaacgcatccatcagatgggcggcaagaaggtcgccagaggcctcgccggccaccatggcgaccttcaaggcccccttgcgcttgaacaagtgatcgctcatagggcttagcggatgatgcctcgcgccgattgtccgaagaagcgggtgaacgcctccagctcgacgtgcccttcggccgcctcggccaggatcgctgccttggcttcatcgtagctcaagccctggcggtacagcgtcttgtaggcgctgcgcacgcggcggatctgctccggcgtgaagcctcggcgcttcatgccctcggcattgatgccggaaggcaccgcgcggttgccatgcgccgtcacgtacgcaggaatatcctgcgccacggcgctggcgaaagcagtcatcgcatgctcgccgacaatgacgaactggtgcacgctggtgaaaccgcccaggaacacccagtcgccgagatgcacatggccggccagcgtcgcattattggccaggataatgtggttgccgacctggcaatcgtgcgcgatgtgcacgtaggccatgatccaattatcgctgccgatgcgggtgattccgccatcctgcaccgtgccggtgttgaaggtgcagaattcgcggatggtattgttgtcgccgatttccagacgcgtcggctcgcccgcgtatttcaaatcctgcgggatagcgcccagcgagcagaactggaacacgcggttgttcttgccgatgctggtgtggccctcgatcaccacgtgcgggccgatccagctgccggcgccgatgctgacattcgggccgatgatagagtaagcgccgatttcgacatcgtcggcgatctgcgccttgggatcgacaatggcggtcggatgaatagtcatgctcacacctcgcgacgggcgcacatgatttcggcctcgcaagccacctggccgtccaccagcgcgcgcgcggcgtacttgccgatgccgcgcttgacggtcatctgcgtcacttcgaacaccagttggtcgcccggcaccacctggcgcttgaagcgggcattgtcgatgccgacgaagaagtacaactcattctccgagcgctcgccctggctcttgatcgccaggatgccggcggcctgcgccagcgcctcgatgatcagcacgcccggcatcaccggatattgttcgaaatggccgacgaagaacggctcgttgatggtgacgttcttcagcgccttgatgcgcacgttggcttccagctcggtgacgcggtcaaccagcaggaacgggtaacgatgcggcaggcagcgcatgatctcgcggacatcgatcgagacagcgtgttcactcatgaggttcttccttcgattttttcagtgtttccagttcccgctcaagctgcttgacgcgcttggcgaaatcatccagatgacgcacgtggacggcgttggacagccagtccttcatgctttgcaaagggtaggacgaggcgtaattgcccgcttccttgatcgacttcgacaccagggtgccgccgccgatatgggtgcggtcggccacttcgatatggccgacgaacatcgccgcgccgccgacggtgcagcgcgcgccgatcttggcgctgccggcgatgccgacgcagcccgcgatggcggtatgctcgccgatttcgacgttgtgggcaatctgcaccagattgtctatcttggcgcccttgcggatcacggtgtcagccatcgcgccgcggtccaccgtagtgttggcgccaatctcgacatcgtcttccagcaccgcgcggccggtctgcggaatcttgaaccagtggtccttgtcccaggccaggccgaagccgtcggcgcctatcacgctgccggagtgcacgccgactcggttgccgatcacgcagccatgataaaccgtgacattgggatgcagcgtgacatcgtcgccgatcacgcagtcgtcgcccaccaccacgcccggcaacaggcggcagcgctcgccgatgaccacccggtcgccgatggtgacgttggcggcgatctcgctgctggcggcgatgcgcgcgccctcgcccaccaccgcgcgcggatggatgccggcgcgcggctgcgcttgcgggtggaacaggctggccagccgggcgaaatacaggtagggatcggcggccacgatcagcgaacggccctgcagctcggctgccagagcttcggtcacgatcagcgcgccggcgccgctcgccagcatctggcggcggagcttggcgtgcgcgacgaaggcgatctcgtcggaaccggcccgctccagcggagccagcctgacgaccgccagatcgtcgccgcgcaattcgccgcccagctgttcaacaatataagcaagtgtataggacatcaaaaacaaagccgaccgggggtcggcttactccggtgacggttgagacgactacttgtccagttctttcaacacctgcggcgtcagatcgaacttgggattgatgtagaccgcgtcttgcaggatcagatcatattgctcgcgcgcggcgatctccttgaccaggcgattggcgcgctcggtgaccccggcgaactcctcattgcggcgctgattgtaatcttccgccaattcgcgcgtcttggcgcggtaatcgcggtccaggctcgcgtactcgcgctcgtaacgcttgcggtcttcctgctgcaggctgtttttgcccagcagggtttccagctccttggcgcgcgcctccatctgcttcatcgcctcgcgccggtcggcgaactccttgtccagcttcttgtagatggcaatggacgcgcccgcctcccggtagatgcgctcaacgttgatgtagcccagcttgaagtcggcagcgtgaaccggcaaggcagccacgctcaaaaccgcgagccaccatttcaatgctttcatgattgcatcctgagaatcgggttagaacgaagcgcccaactggaattggaagcgctggatcttgtcattcggttctttcttcagcggattggcaatactgaatttcatcggtcccatcggcgacagccaagtcaaggccaagccggcggaatagcgcaggccgttgctggcattgctggcggtttgcggatcgttcggacccggggtccagctggtgttccacaaagtgccggcatcgaagaacaggctggtccgcaacgatttattatccttcatccccgggaaggggaacaggatttccgcattggccaccaccttgcggttgccgccgatgaagttgccgctgccgtctaccgggccgatgctgctggtatcatagccgcgcaccgagcccaggccgcccatgtagaagttctggaagaacggcagctgcttggtcttgccataaccgtcggcatagcccaactcgccattcagcatcaaggtgaagtctttggacagcgggaagaaccaggtctgctgatgagtcagccggtagtactgcatgctgccgccaggcaagccggcgtcggcgttcaccttgatggaggcgccgcgagtcggccacagcgcgctgtcgcgggtgtcccgcgcccagcctaccgtgcccagaacggtgtaattgctgttgccgtatttgttgacgaaatcgatgtattgcgacgggctgttcgcatacgtggtgatatcggttttttcggcgcccagcgtgaagttgatgcgatcatattcagtgattggcaccccgaaacgcacatccgcgccgaccgtgctggtcttgtacgccgaaatcgacgtggcgtccgggttgtagacgcggtcataaatgtcataacccaggctcacgccgtccggcgtgaagtaagggtcggtgaacgacagcgagtaattcttgttgacctggccggtggacatgctcagcgacatgtacttgccggagccgaagatgttgctctgcgaaatgctggcgcccagcaccaggccttcgccctgcacatagcccaaactgccggaaatgctgccggtggagcgctctttcaggctgatgttcatgtcgacctggtccggcgcgtcggacaccgccggcgtttcgacgttgacgtcttcgaagtagcccagcagctccagtctttccttgctgcgcttgacgtcggcggcgttgtacggcgcgccctccagctggcgcagctcgcggcggatcacttcatcgcgggtcttgctgttgccggccacgttgacgcggcggacgtaggtcttgcggcccgggtccacgaagaaggtgaaggcggcggtttgtttgtcgtgatcgatgtccggcagcacgttgacgttggcgaaggcgtagccggcgacgcccaggcggtcgctgatcgccttgaccgactcggtcactttctcgttgtcgaaggtgtcgccgctcttgatcagcaccagcttgcgcagctcggcttccggcactttcaggtcgccggccaggcgcacgtcggacacggtgaacttcttgccctcgtgcacgttgatcaccagatacatttcctgcttgtccggactgatcgacacctgcgaggaatcgatcgcgaactccatatagccctgattctggtagaaggctttcagcttctccagatcgccggtcagcttctgcttcgagtattgatcgtccttggtgatccaggacagccagccgccggtggtcaggctgaattcgtccagcagcttcgactgggcgaaggcgttggccccgacgatgcggatttccttgatgcgggcggtgacgccctcgttgatgtccagcgtcaccgaaacgcggttgcgctccagcttggtcaccgacggggtgatttccaccgaatacttgccgcggctatagtattggcgcttcagttcctgcaccgcgccgtccagcagcgcctggtcgaagatcagcgattcggcgaaaccgttgtccttcagcgctttcttcagctggtccttgctgaattccttggcgccgttgatgttcagctgggtgatcaccggacgctcggcgacggtgacgatcagcgtgtcgccgcggctttccacccggacatcgttgaagaagccggtgttgaacagggccttgatcgactcctgcgccttggcgtcggtgaaggtgtctcccaccttgaccggcaaatagttgaagaccgtgcccggctcggtacgctgcaggccttcaacgcggatatccttgattacaaacgggtcagcagccatggcgacggaggccatggacaggcccaatacggccgctgcgagtcgcttcaatttcataggtgtgctttaacccccaaatagccggctgaaatcattcaggatggcgaacgccatcaaagacgccagcaatatgaaaccaattttctgtccgagcaattgcacccgttcgctgacgggcttacctctaaccagctccgcgacataatacatcaagtgcccaccatccagaaccggtataggcagcagattcaatatgccgatgctgacgctgatcagcgccaggaactccagatacggcgtcaagccttcacgcgcggtctggccggcgacattggcgatggtcagcgggccggacaggttgtcgagtgaagcgtggccgatcaacatattgccaaggaacttgacgctcatccaggcggtgtcgccggtcttggtcgccgcggccagcaaggcccccatcgcatcgtaatgcagagtgaagcccagcttgtcgttccaggcgcggtcgggcatcggccccacgccgatccgccccaccacctcgtcatcctgcgtcaccgccatcggccgcagtttgacttccatgtcctgccccttgcgttctatgcgcagcgccaaatccttgccgggactgttgcgcacgatctgcacccattcctcccagctgcgcagcatcaccccattgactgccagcagcttgtcgccggtcttgagaccggcccgcgccgccacgctgttttcctccagcgcgcccagcaccggcaggaagcgcgccggagacaggcccggatcgccctgctgcaaggcctgcgccgccttgtcgccgaaacgttgggcgtcgatgcggcgctcgcggctggcgccggaagcgttttgcaccaccaccggcaccgcgccgcccgacatcgccgcatccaccagcgccaggcggacatcctgccagctggacacccgctgcccggctacgctcagaatgcgttcgccttcctgaaagccggccgccgccgccggcgtctgcccgatcacagtgccgatcagcggcttcaactgcggcacgccctgggcgatcacgccccagtacagcagcaccgccagcagcagattggccgccggccccgccgccacaatggccatgcgcttgagcacatgctgattgttgaaggcgcggccgcgttcggacggcgcgacgaaaccctcgcgctcgtccagcatcttcacatagccgcccagcgggatcggacacaccacccactcggtttcgcgcgggcgaaaacgcagcaagggcgagccgaaaccgagggaaaagcgcagcaccttcacgccgcacagcttggcgacccaataatggccaagctcatgaaaagtcaccagcaggccgatggccaacaaaaaagccaggagcgtcagcatgccgccaccctgccgcgggcgaagcgccgcgcatcctcatcccgcgccagcagcgcgtccaggcttgcgctggcggccaggtccactcccgacaaggtctcggataccaccttgggaatgtcgacgaagcgcagccgcccgttcaggaaggcgtccaccgccacctcgttggcagcgttcagcaccgccggcgcgtcgcctcccatcgccagcgcgtcgaaggccagccgcaggcaggggaaattcgccagatcgggcttttcgaaactcaggctggacagcgagaagaagtccagcggttctacgccggcgtcgatgcgctccggccacgccaatgcgcaggcgatcggcgtgcgcatgtcgggggagcccagctgcgcgatcacggagccgtcgcggtactgcaccatcgaatggatcacgctctgcggatgcaccaccacctcgatctgctccggcggcacgccgaacagccaatgcgcctctatcacctccagccccttgttcatcaaggatgcggagtcgaccgatatcttgcgccccatgctccagttggggtggcggcaggcgtcggccggcgtcacgtccagcagctcggccgcgctcttgccgcggaatggcccgccggaggcggtgagaatgattttgcggatgcccgccagcgcaggctggccggcatagtcagcgggcagcgactggaaaatcgcgctgtgctcgctatcgaccggcaacaggccggcgccgctgcgccgcaccgcgtccatgaacaagcgccccgccaccaccagcgattccttgttggccaacagaatgcgcttgccggcgccggcggccgccagcgcggaaggcaggccggccgcgccgacgatggccgccatcacggcatccacctcgggcaggcggacgatctcctccaacgcctgaggcccatgcagcacctcgcccggcaggccagcctgctccagtcgcagcgccagttgcgcggcggcgtcagcatcggccacaaccaggtaatccggccggaagcggctggcctgctcgaaaagcttgtccagctggcgatggccgctcagcgccaccacccgatagcgctccggatgccgggcgatcacgtccagcgtgctgcagccgacgctgccggtcgcccccagcacggcaataccctgaggtttggtcatttgaatcgattccagaattacatgccgcccagcgcgcgcagggcattgctgaccgccagcacggcgatcaggctgtcgatgcggtcgtacacgccgccatggcctggcagcagacggctgctgtccttgacgcccgcggcgcgcttgaaccacgactcaagcaaatcgccgcacacgctcaccgccgtcagcggcaaggccagcaacaacagcccccacagcggcagcttgatgtccagccagccgaaatgatccaccaatgcgacgtaaaccgccacgcagatcacggcgccatatacgccctcccagctcttgccggggctgatggccggcgccagcttgcgtttgccgaacgccttgccggaaaaataggcggcgatgtccgccacccataccaggcccatcaccgccagcagggccaaagcatcgtgccggctaggctgcgggcgccactccaggaaggcaaaccaggccggcagcatcaatacccagcccaacagccaggccggcgcgccgcccgggatggtccagcgccgcgccagccagcacggcatcaacgccagccagaacgccagcaccacgccatgcagcagcggccccgccttccagcccatggcccagcaaacggcggccagcagcgaagagagaaccaggtaacaggcctgctgcggccggcccatgccggccatgcgggagtactcccacaacgccagcccgacgatcagccaggaaaagccggcccagatgggggccggaaaaaagaaaagcgccgccagcatcaagggcagcagcgccagcgcggtcagaattcgcgttttcagcatgaatggtcagggtgtgtcgcggcgcaaatgttccggcaattgctcgctggtgcgaccaaagcgccgttcacgctgccaataggaagaaatcgcctgctccagcgccgcgcggtcgaaatcgggccaaagcagatcggtgaaatacaattccgaatacgccaactgccacagcaggaaattgctgatgcgctgctcgccgccggtgcggatgaacagatcaggctccggcgcccaggacatggccagacgcttggtcagcgcctcttcggtaatcggcgccacgccttccgcgaccagttgattcaccgcgttgacgatatcccagcgaccgccgtaatcggcggcgatggtcagaaccaagccgtcgttgtcggcggttttcgcctcggcgcgcgcgatgcgctcagacagctccgcgctgaagcgctcgcgcgagcccagcacctgcaggcggatattattgctgtgcagcttgctgacctcgtgctccagcgcgcgcaggaacaagtccatcaggaaggtcacttcctcctgcggcctgcgccagttctcagtggaaaacgcgaacagagtcagatagccgacgcccatttccttgcaggcgccgaccacctcgcgcacggcgtccagcccgcgcttgtgcccggccaccctgggcaggaaccgcttcttggcccagcggccgttgccatccatgatgatggccacatgccggggcggctggcgcccctccggcattggtttcaaagaaccggaaaacaaggcctgccccttatactgcgagcaggtcggcttcttttgcggccagcgccttgtcgatctcggcggtgtacttgtcggtcagcttctggatctcgtcctggccgcggcgctcgtcgtcctcggtgatggacttgtccttcagcagattcttgaattcggtgttggaatcgcggcggacattgcgcaccgccacgcgggcgccttcggcctcggcgcgcaccaccttgatcaggtccttgcggcgctcttcggtcagcatcggcatcggcacgcggatgatctcgcccatggaagccggattcaggcccagatcggaatcgcggatggctttttcgatcttcgccaccatgggtttttcccaagcctggacgccgatggtgcgggcgtcgatcagggtgacgttggcaacttgattgaccggcacgtcgctgccgtaataatcaaccatgacatgatccagaatgccggtatgggcgcggccggtgcgaaccttggacagatcgtttttgaacgattccagtgttttttgcattttttgttcggccgacttcttgacgtcgttaatcatgtccactcccatcaaaacttcaaatgacaaggcgaaaacagccattgccgttttcgccctcagcaattttcaaactcagcagtgtaccagcgtgccttcgtcttcgccaagcacgacccgcttgagcgcgccgttcttgaagatgctgaagaccttgatattcagatgctgatcgcggcacagcgcgaaggcggtggcgtccatcaccttcaggttgcgcgagatggcctcgtcgaaggtcacgctctgatagcggaccgcatcgggattctttttcggatcatcggtatacacgccgtcgaccttggtggccttcagcatgatgtccacattcatttccatgccgcgcaaggcggcggcggtgtcggtggtgaagaaggggttgccggtgccggcggcgaagatcaccactttgccttcctccagatattgcatcgccttgccgcgcacatagggctcggcgatctgctgcatggtcagcgccgactgcacgcgggcgatcaggcccaccttagtcatcgcatccttcagcgccagcgcgttcatcacggtggccatcatgcccatgtagtcggccgtagcgcgatccatgcccgcggcggccggagccacgccgcggaagatattgccgccgccgatcacgatgcccacttcgatgcccagctcgaccacttccttcacctggcccacgatctgctcaatggtggtgcgattgatgccatagctgtcgtcacccatcagggcttcgccggaaagtttcagcaggatgcgtttataggcaggaacttggctcatgatgtcctcggattggcgatttgtggttttcagtttgcaaaacggcaccctgcaggcagggtgccgtcaataaagcggtaagcctgggcttacagcttggccgcggcggcaacttccgctgcgtagtctactaccttcttctcaatgccttcgcctactacgaacatggcgaacgccttgacggaggctttctgctcggccagcagcttctcaacggtcaggtccgggttcttgacgaacggctgacccagcagggtcacttcagccaggaacttgttgatgcggccttcaaccatcttggcgacgatgtcggccggcttgccggattcggcagcctgagcggtgtagatcttgcgctcttgctccagggtctcggccgaaacctgatccttggaaacacagatcggcttggaggcggcgatatgcatggccacgtctttgcccacgctctcggcgccggcgtagtcgacgatcacgccgatcttcgcgccgtgcaagtaggtggcgatagcgccttcggtcgagtagcgaacgaagcgacggatggtcatgttctcgcccagtttggcgatggcggccttgcggatttcctcaacggacacgccgtcgatttcaaccgcggacagggcttccacgtcggccggattggcgatgacggcggccttggctgcggcagcggccagagccaggaaggtcggatccttggcaacgaagtcggtttcgcagttcacttcaaccagcgcgcctacgccgccttcaacatgggaaccgataatgccttcggcagccagacgaccggccatcttggaggccttggtgccggacttgatgcgcaggatttcttcagccttggcggcgtcgccgtccgcttcaaccagagccttcttgcactccatcatgccgaggccggtggccacgcgcagatccgaaaccatttttgcggtgatttccgccatgtttcactcctaatgatttagattacgtaaacgatcgggtccaaaaaaaggggcttgcgcccctttctggtccgcttactcggcttgcgccggctcagcggcggcgacgatctcttgcagagagtgcgcgcggccttccagtaccgcgtcggcgatgccgcgagcgtacaggcggatggcgcggctggagtcgtcgttacccgggattacgtaatcgatgccgtccggggagttgttggtgtcaacaacgccgataaccgggatgcccagtttcttggcttcgacgatggtacccttctggtagccggtgtcgataacgaagatggcgtccggcaggcccttcatatccttgataccgcccagcgagcgctcgagtttgtcgacttcgcgctgcagatccagcagttctttcttgttgtaaccggtatcgccggaaccttccaggatggcgcgcttctcttcaagacgcttgatcgactgcttcacggtcttgtagttggtcagcatgccgcccagccagcggtggtcaacaaacggcatgccgcaacgggcagcttcttcacgtacgatctcacgcgcttgacgcttggtgccgacgaacatcacggtacccttgttggcggccaggcgacgcacatactcctgagactctacgaacagcggcagggtcttttccaggttgatgatgtggatcttgttgcggctgccaaagatgtacttggccatcttcgggttccagaagcgggtttggtggccgaagtggacaccggcctcaagcatttgacgcatggtaacgttggtggacatgcaaaaactcctaaagggttaagcctccatccgcgcagacaacccgcctgaacgcaagttcagccaggcacccttttgcgcggatgtgcgtagtttggtttatatcccccgccagaatggcagagaacacgagattctagcacccaaaggcccgccagctcaagctttgccggcatctttctccgccgcgcggcggcggcgcagcttgttgcgcgtcgcccacgccacaaaccaggtcggcagcacgcccagaaagaaggcgaccgccagaccgcccgccacgctgccctgggtcagcgccagcatcagcaccacgtaaagccagcccatcagcacaatgatcagcgtcatgaattaaacaatcgtttgaattttaggacgaatacatcaacaatagacccgcattgtaaaccagccgcgagttccagccatgcaaaccgccattacccgcctgttcgatatccggcatccgctgatttgccccggcatgagctatatcgccacgccggaattggtcgccgccgtcggcaatgccggcggcctcggcatcctggccagcggcccgctgtcggccgacgccacccgcgccgcgatccgccgcatccgcgaattgagcgaccgccccttcggcatcggcgccactctgatgatgcccggcgctgccgacaacgcccgggtggcgttggaagaacaagtccccgtcatcaactattcgctgggcaagggcgactggatagccgaagccgcccatcgctatggcggcaaggtggtcgccaccgtcaccaccgaaaaacatgctgtctcggcggaaaaaagcggcgccgacgcgctgctggtcaccggccacgaggccgccgcccacggcggcagcgccacctcgctggtgctgatccccgccatccgcaaggccagccgactgcccatcatcgcggccggcggcttcgccgacggcagcagcctggtcgccgcgttggcgctgggcgccgacgccgcggcgatgggctcgcgcctggccatgacgcgggaaagcccggtgcacgccaagaccaaggacatgatccgcgaacgcggcgtggccgacacgctgtactcgaagaatttcgacggcctgtggtgccggatgatggacaccccgaacgcccgcgcggcctgccgcaagccgctgggcctgctgccggcggcgttccgcgccagccggatggcgcggcgcatgggcatgccggtgttgaaagtggcgctgggcggcatgatcagccagccgcaggcgctgcgccagttggcgctgttcggcgcggcgaccgagtcgatacggttggcgatacaggatggcgaccacgacaaaggcgtgcagctgataggccaggcccagggcctgatagacgatgtgccgacggtggccgagctgttcgagcgcatcatgcaagaagcgcaagcctgccggcaacggctggccggctactgaaagcgcgggcgaaagccggcgcccccgcgccggctgcccgcccccagccctagcctgacacgcgcatatcctcgccgcgccgctcgcggctgaagcgtatcaacaccgcgatggcgatcgccacaatgccggcgaccgtagccatcgccaggccgtaatcgccgccgttcatcttggccatatgcgcctgcatcggactgtttaccgaagccaatagattgcccagttgatagaccaggcctggaaacgtggcgcgcaccgcagttggcgaaatttcattgaggtgcgcgggaatcaccccccaggcgccctgcaccgcgatctgcatcaggaaggccccggcggccagcatcaacggcgtggacgagaacgcccacagcggcaataccggcaaggcgaacagcgccgccagcgtgatggcgttgcggcgccctatccgctccgacaagcccccgatcgccagcccgccgacgatggcgcccacattcaggcaaatggcgatggtctgcacggtatgcggatcgaacttgtgctgcaccctaagaaaagtggggtacatgtcctgggtgccgtgcgagaagaagttgaaacaggtcatcagcacgatggcgtacagcgacaagcgccattgcgcggcgatggcttgcagcagccccggcttttcctgccccctcgccgcctcccagctgggactttccggcacgttgcggcggatgtacagcgtcagcagcgccggcagcaggctgagcatgaacatgccgcgccagcctatgtgctcgaacagctggccgaaagccagcgtcgccagcaggtagccgctgggatagccggcctgcagcaggccggacacgaaaccgcgcgattcgcggggaatgctctccatggtcagcgacgagcccacgccccactccccacccatcgccacgccgaacagcgtgcgcagaatcagcaagaccatcaaattgggcgaaaacgccgacgcgaagcccagcaccgaatacatcacgatattggccatcagcaccggacggcggccatagcggtcggccagccggccgaagatcagcgcgcctatcggccgcgccgccagcgtcagcatggtggcccagctgaccgcctcgacatcggtgccgaactcgcgggcgatgtccttcagcacgaacaccatcaggaaaaaatcgaacgcatccagcgtccagcctagatagcaggcgaaaactgtttgcctctgctctttggtccatgccatttccatctcctcacatcattcttctaacagcgcacgcttcatgatatgtgagttttttggcgaagaagccgcaagacagaatttgcaacacattcgcccgcggccgttcaatagggctgcggatcgtatttgcccgcggcgaaatcacgcgccatctgccgatactcggcgctcgccttcaatttggccagcccggcgttgaagcgccgcagcaaggcctcgccgcccggctgtttgcggctgaacatcacaccatattcagcgcgcacgaacacatgcggctccgccacgatcgccgcctgctccctgggagtgaaatgctggcgcaacacgctgaaacccaccgagcggatcaagggaatgaaatccagcctgccgatcagcaactggcgcatcccggcctcgatgtccttgacgacgtaactgcggatgcggccggcatctatcgcctcctgccacgcccccagccgcgagccgttgaaagtcgccatcgtcaggccgtagaaatcctcgatgcgctcggtcttcatcttgcgggtggcaagatggaacaccacctcgtcgtccacgatcaccggatcgctgaaccaggcgaatgcccgccgctgcggcgtttcagaccataccagcgagccggccacgccgccgcctcgcaccatggcctcagccctggcccagggataaaaacggtaaatcacctgaatcccggccaaacggaacgcctcgctgaccacgtgagaggcgaagccctgatgcggcagcttcgccgactgatacggcgcccattcgccattggcgagcaccacctcatccagcgcccatgcccgcgccgccgccccggccaagcacaaaccgcacgcgatccaggccaggcaacgcatcctcatctccccgcgcatcactgcatccagcctagccgctgccgcctccgcccgccaccacgccaacccggccttcacccaaaagcttgcgggggagatggcgatggagaatacggacagccttgctctgcctggcctgctgcggccacctggacatcagcggcctgaccgcgccctatcggccgcaggcctgcggcttggccaacgccatccagtccgcctgcccatcgccagcctcagcaacgccggtcgccatccgggactcgacgtgcggcgccaacgggccgggatcggccgcttcaacaacagggacgccccgatctccgccctctatcggcatggacggcgcctgagcgggccgaccgcagccgccagcgatttcaaacaaatcgcgattgacgggcgcgaccgcagcgacgtcggctgccagagcaactacgtcagctgcgtcaccggcagcaacggccgcccccgcgccggcgccagcctgaacaggcgctgattgtccgacccccgccagggcttgctggtcggcaagtcccggcggtagcggccatcgatcagcacatcgacgaaacgcaggatctccaactcccgcacctcttcgtagtcgtaaccagtccacagccagatgctcttgcccggatagcgttgtttgaacgcgcggcacagcgacaggatttcatcgcgattggccggcagcagcggatcgccgccggacaggctgaggccgtcatggccggcgcaatgcgccagcagagcctcccgcacctgggcagtgaacggccgcccgcttttgcgatcccaggtggagcggttgtggcagccctcgcaggcatgcgcgcagccggtgacgaagagcgtgacgcgcacgccctcgccattcaccaaatcgcaggtgtagtagcgatcgtaattcatggatcgatcaatgctcgccgccgaagtgcttgacccggcgcatcatttccttctgcttgccggcattgaacggacgcgcattgggactgcccaggtagccgcacacgcggcgcgtcaccgacagcgaggcgctgtcgcgattgccgcattgcgggcagctgaatccatccgccgcggccagcgcctctcccatgaagccgcaggcgccgcaggagtccaccggcgtattgctgccgaaatacggcaccctctccagcgcgtaatcccagatccgctccaacgcctgcagattgtgcttcatgttcggcaattcgacatagcttatatggccgccgctggccagctcggcatagccggtttcaaagtctatcttctcgaacggattgaccttgcggaacacatccagatggaaggaattggtgtaatagcccttgtcggtcacttcggcgatgtcgccgaagcgctcccggtccaatttgcagaaacggttgcacagcgactcgctgggcgtggagtagagcgagaagccgaaaccggtttcgcgcttccactgcgcagcggcctcgctcaggcgggccaccacccggcgcagaaaaacctgagcaggctcgctgtcggccggatgcgcgccgaacagcagcacgccgacttcgtgcaggccgatgtagccgagcgagatcgacgcccggccgccctgaaacagcgccatgatgtcttgatccggcttcagccgcgcgccaaaggcgccctcggtatacagaatcggcgcgacattggccttgacgccgcgcagccgctcgatgcgcagcatcagcgcgcgcaagcataggcccaagcgcccctccagcagcgcccagaacgcctgcgcgtcgcccctcgcctcgatggcgatgcgcggtagattcaagctgaccacgcccagattgttgcggccatccagcacctcccggcccgcctcgtcgcgccaggccggcaggaagctgcggcagcccatcggcgaaaccggcaccgatgagccggtgatgcgtcggctgagctcggcggagatgatgtccggatacatgcgtttggacgcgcactccaaagccagctgcttgatgtcgtaattcggatcggccggccgcagattgacgccctggtcgatgaacatcaccagcttgggaaaaaccggcgtgacgccctctttgcccagccccttgatgcgcacgcggaggatggactgctgtatgatgcgcgcctcccagcccaggcccatgccgaaggagaaggtgacgaagggctgctggccattggagctgaacagggtgttgatctcgtactcgcaagcctggatgccgtcgtacgtttccttttcggcgcgctcgcgggcatagcgttctggctcggtgatgccgtactcccgggccacctccagatttttgcgatagcttttcagcacatagggcgccaaaacctgatcgatattgggaatggtggtgccgccgtactggtggctggccacctgggcgatgatctgggcggtgacggcgcaggcgacgcctatcgacctggggctttcgatctgggcgttgccgaggcggaagccctgctccagcatgcctttcaaatccaccaggcagcaattggtgaacggcaggaacggcgagtaatccaggtcatggaaatggatgtcgccgctgttgtgagcagccaggatgtccttgggcaggaagttgccggcaaactgcttggagacgatgccggccatcaggtcgcgcatcaccggaaacacattggcgtccttgttggcgttctcagtggcggcctcttcgtcggttctgtgcaccagccccatcagcttggcatgcagctcggagccgcgcgcgcgcacgctgtcgcggtcatggcggtactgaatgtaaacccgcgccacttcgggatactcgcgcatcagttcgtcctcaaccaaacgctggatcgccgcgatgctgatccgcccctgcgccgagcgctcgcggcagcggcgctccaccgcggcggcgatggccaacgccaacgcggccggcgccgcatggccggccgccgccgccgcccgctggcatgcattggcgatcttgccgatatcgaattgcgtcactgcgccgtcgcgcttgctcacttgcacatcgcacctcctggcatggctatccaaccggccggcttgccgccggccgggaaacgttgccactgtatgcgatttgccagcaggctgccgcgctatttttacaaaatgtagatatggaatttgctcgtaatcaatatatggtgctttcgcctgccaagtcggcttgggcggacatcctgcggaaccatttcacgccattggcatcatacagcgctatattcatccttttatcctgacagcgagcccgccatgcactccccgcttcccgccctgctgctgaccctgccgcttgccagctacgcccacgccgccgaacaagtccagggccagggtgggcgcatcctgcattacagctccacccagacccgctccgacctggaccacgaggagcaaaaccgctaccgcaaccatcgcgaccaccagttcaacggcgccagcctggccgccgtgctgcaggcggcgcagagtgcgctgcatcagcacggctacggccagatcgaagcggaaccggattaccacgtgattcgcgcgctcaggcacgagcagctggtcagccgcggccgccaggtgctgcgcggcatcctgaagctcaagctgccgatgccgggcaagcccgaccaccagagcaccgagctgttgctgatgctgcgccccggcagccagccgcagcaggtgctggcacgcgcgcgcctggaaaccaccgtctgggacagcaacggcaactcccacaccaagctcgacagcgatccggacgactaccgccagctatacggccatatcgacgccgcgctgcgaggacgctaaggccgccaaacaaaacaccccgctgcctgcgaacaggcgacggggtgcgggtcttgcgcgaagcgcggtcggccggcttagttgctttcagccttggacatgcggcgacgctcgttttcctgcaggtaacgcttgcggatgcggatggatttcggggtgatttccaccagctcgtcgtcgtcgatgaactccaccgccgattccagcgtcagcttgatcggggtggtcagacgaaccgcttcgtcggtgccggaggcgcggacgttggtcagctgcttgcccttgaccgggttcaccaccaggtcgttgtcgcggctgtgaatgccgatgatcatgccttcgtacagtttttcgcccggggacacgaacatgcggccgcggtcttccagcttccacagcgcgtaagcgacggcttcgccgttttcctgcgagatcagcacgccgttgtggcggcccggcatgtccggcttcaccggcgcgtagtcgtcgaacacgtggctcatcaggccggtgccgcgggtcatggtcatgaagtcggactggaagccgatcaggccgcgggccggaatgtggtattccaggcgggtgcggcccatgccgtccgattccatattggtcagctcgccgcggcggcggccgatttcttccatcacgccgccctggtggtcgtcttccaagtcgatggacaggttttcgtacggctcgcacttctggccgtcgatttccttgtaaaccacgcgcggtttggcgacggccatttcaaagccttcgcgacgcatgttttccagcaggatggtcaggtgcagctcgccgcggcccgaaacgcggaagatgtccgaatcttcggtgtcttcgacgcgcagcgccacattggtcagcagttccttggtcaggcgatcgcggatctggcggctggtgacgaacttgccttcggtgccggccagcggcgaggtgttgaccatgaagtccatggtcagggtcggctcgtccacgcccagcaccggcaggcctaccggctgctctttgtcgcagatggtgacgccgatgccgatgtcgtccaggccggagatgatgatgatgtcgccggcttcggcgccttccaccggcacgcggtccagaccctggtaacccagcacctggttgatgcggccggaagccacttgctcttcatggttcatcaccaccacttgctggcccggcttgatgcggccgttcagcacgcggcccacgcccaggcggccggtgtaggtggagtagtccagcgcggaaatctgcagctgcagcggcgcgtcggcgtcgcccggcggggtcggaacgtgcttgagcacggtctcgaacagcggacgcatattgtcggaggtttcttccagttccagcttggcgaagccattcaggcccgaagcatagatgatcgggaagtccagctgctcgtcggtggcgcccagcttgtcgaacaggtcgaaggtttggtccaccacccagtccggacgcgcgcccggacggtctaccttgttgatcaccacgatcggacgcaggcccagggccagcgccttcttggtcacgaagcgggtttgcggcatcgggccttcaacggcgtccaccagcagcagcacgccatcgaccatgcccagcacgcgctctacttcgccgccgaagtcggcgtgtcccggagtgtcgacgatgttgatgtgcacgccttcgtattcgatggcggtgtttttggcgagaatggtgatgccacgttctttttcaagatcgttgctgtccattacgcgctcgtcaacctgctggttttcgcggaaagtgccggactggcgcagcagttggtcaaccagggtggtcttgccgtggtcaacgtgggcgatgatggcgatgttacgaatttgtcgggtcatgtctcaggcggctatctggaaacagaaaaatcgaaagattatagcatgatagccaagcaccaagaaaatttcggtaaaaacagattaccgttttgtatttttcacgttaaagcgatggcggcggcaaactcgtcgcgcggcggttttgccattaaactgccagccatcaggcaacaaggaacacaagacatgtacgactggaacgcattgtggcatgagcgcgaagcctaccgcaccggttacgacatccaccacggcgacgccaatatgctggccgagccgctcaaggccaagctgatccacgccgccgaaacgccggaccaggtggcggtgtacgaagacgcccaccgctacatcctggccggccacgccgacggcctgcagctgctggaagtgttcaagcacggcctgttcgacatcaccctgcgctttgtcggcgaagacgagggtcaggacgccgccgtgccttatatagagctgcatgtcgacaacctcgccaccgaggagcaggcggtatggcgcggcgaggcgcagctggatgaagaaggtcgcgtctggataggcaagcgcacgctggacgaagacgtgctgccggcgatgcccttcgacgaactgtcctttaccgaccaggccgtcttccgcgacgaactggcccgtgtctggcatgaagacctgccgcaattgcgtccgctgatcgaagcctggttccgccacgacgaactggcggcgccgcaggacgagccggcccactacggcgaccaggagcgcgtgatgcagatctgcgaccgctacgccgaaatcgtccgccgcgaacaggcggcgctgtcgcggctgttcagcgacgacgagctgcggctgatggccggcgtgatcggcagcgtgcatttcgacagcgccgcctcctgccgcggcgtctggctggccgtggaggcccgcatcatcgaagacgagctggatcagcaattccagctggacggcgaggcgctgctggccaagatgaaaggcttgagctacgcgcaggaagtggcgctgatcgaggcgctgtcgccgctgaaatcctgagagcatgggccaaaagcggcgatcgctggtatcatgccgccggatttcgagcaatcacactaaaccttatatcgcgccgcggacgccatcgcgcgcggcgcgccgctggcccgaacgcctccagacaaggagccgatcggcgcctgaaacccaccatggagaatgcaatatggctcagccgattgccctgagaaacctgccgcaaagcaatatcttccgccccggcgacgtattcgtgctgttcggcgagctgttcggccgcggctacgccaatggtctggtcaaccaagcccgccaggccggcatggagatcatcggcatcaccgtcggccgccgcgacgacgacaaccgcctgcgcccgctgaacgacgaagaactggcggccgccgaggccaatctgggcggcaagatcatcaacgtgccgctgatggccggcttcgagctggacgcccccgccggcgaagccaccccgaccgagctgctgggcggcctgacgctgaaaggctggcaggacgacaagctggactgggcgcatatcgaaaaatgccgccaggtcggcgtcaagcgcttccaggacggcgtcgccgaagtgatggccaagctggacggcatgatcgccgacggccgcaacgtgttcttcgcccacaccatggccggcggcattcccaaggtcaaggtgttcctcgccatcgccaaccgcatctacaagggccgcggcgaccgcttcctgtcctcgcaggcgctgctggacagcgacctgggcaagctgatcctgcaaaacttcgacgaagtcaccgccaacaccttccagcacctgatagccggcagcgcggccttgcgtcgccgtctggaagccagcggcggccaggtgcgctacaccgcctacggttaccacggcacggaaatcctgatcgacggccgctatcagtggcagacctacaccaactacacccagggctacgccaagatgcggctggagaaggtggcgcaagccgcctgggagcaaggcgtcaaggccacggtgttcaactgcccggaaatccgcaccaattcctccgacatcttcgtcggcgtcgagctgccgctgttcgcgctgctgcgcgcgctgaagaaggaagcgccaggtgcctggaccgatagccaatggcgggactgcgccagcctgctgaaggacggccacgcgctggaaacgctgctggaaaagatagacgcgctcaacgacggcgcggtgatgcagggcttccgccgcttcgacgcctggccgatgcccaacagccccgagctggccgaggtgatgataggcacgtcggacgagctcaccgacatgcacctggaccgcaaggcgctgatcaccgaccgcctcagcgcgctggtgatcgaagccgccggcccgctgatgttcggcgaagcctcgcagccgtccggcccggtgctgtggctgaaccacgacatcatcgccagccagctcaaacagctgcacggctgatcgcggcctccccccgcgcgaaaaaccccgcagccgtcaggccgcggggttttcttttagccggcggcctgcgtcgagaacatcgtcagcaccaccttgcccagattacggttttcctcgacgtagcgatgggcgtcccgcacctgggtccacggaaagctgcagtccaccaccgtgcgcaagcgtccgtccaggatgccgggcaggatgcgctcgcgcagcgccgccgccagcctggccttcgccgcgggcggctgcggccgcagcgtggagccgatcaggctgatgcgcttcatcagcagccggccgaaatccagctcggccttcaaaccgcccatcagcccgatgttcaccagcctgccgtccggattcaaggcctgcaggttttccgccagataggccgcgcccaccgggtccagcaccgcgtccgcgccgccccagcttttgaccagctcgctgaaagccggcgtttcccgatagttgaatacttgcgcggcgcccagttcgcggcagaatgccagcttttccgcgctgccggcgctggcgaaagcccgcgcgcccagcaagccggccacctggatcgccgccacgccgacgccgctggcaccggcgtgcaccagcacattgtcgcctgcggcgacgccggccttctccgccaggttgaaccaggctgtcatccaggcctccggcaggctggcggcctccacccaggacagcgcgtccggcttggcgatggccaaggcttcgtccagcagcgcgtactcggcatagccgccgccctcaaccaggccgaacaccgcgtcgccgggctgaaaggctgaaccttccgccgcctcttccacccaaccagccacttccaggcccagcagcgggctagcgccgggaggcggcgcgtaacggccctcgcgctgcatcatgtcggcccgattcactccggccgccatcacccgcaccagcagcttgccaggcgccagctgcggccgatcccattccgccagctccatcgtctccgccccgcccggcccttgctggaccaccgcctgcattttcatcgcgctctccttcgcattgagtccacagcacatgaggccggccgccgcctatctcaagtcaatgcgcgaaatattcgaatacggcgacatatgccatgagctggatcaagcaatggcgaccggctttgattacaatgccccgtcatgagcgagaactgtttccattgcggcttgccggtcccgcccggcgccgatttccccatccgctaccgccagcgcgatgaggccgcctgctgcgccggctgccaggccgtggccgccaccatcataaattccggcctgtcagactactatcagcaccgcaccgagggcgcggcccgcgccgaagcgctgccgcagaatctgctggaacagatccggctgtacgattccgacgaactccagcgcggcttcgtccacattgaccgcgaccaggtgcgcgaggctgcgctgatgctggaaggcatcacctgcgccgcctgcatctggctgaacgaacagcatctgcgccggctgccgggcgtggtcggcgtcgacatcaattacagcacccagcgcgcccgcgtgcgctgggacaacagccgcgtcaagctgtccgccatcctggaggcggtggcagcgataggctaccgcgcccacccctacgatgccgagcgccaggaaaagctgcaacagaaggagcgcaagcaggcgctgagccggctatgggtggccggcttgtcgatgatgcaggtgatgatgtacgcggtgccggtctacctggcgccggacggcgacatcgcgcccgacctgctgtggctgctgcactgggccagcttcatcctcacgctgccggtgctgctgtattccgcgctgccgttctaccgcgccacctggcgcgatctgaaaagcggccgcgtcggcatggacacgccggtgaccataggcatcctcaccgctttctgcgccagcttctgggcgctgatccacaagttcgagcatggcatctatttcgattcggtatcgatgttcgtgttcctgctgctgggcggccgctacctggaatcgatcgcccgccgcaaggccggggccgccagcgaaagcctggtcaagctggtgccggccttcgcgcaccggctggacaattggcccgccagccgcgacagccatgaagccaccgtcgccagcctgcgccgcggcgacgtgatcctggtccgcccgggcgaaaccatccccgccgacggcgtggtgctggatggccaaagcgccagcgacgaggccttgctcaccggcgaaagccggcccattcccaaaaccgccggcgacgcggtgatagccggcagcgtcaacacctccagcccgctgctgctgcgggtggaggaaagcggggagtcgacccggctggccggcatcgtgcgcctgctggaccgcgcgctggcggaaaagccccggctggcggtgctggccgaccgcttcgccagctggttcgtcgccctgctgctgctggccgccgccgccagttatctggcctggcatttcttggaccccggccgcgcgctgtggatcatggtggcggtgctggtcatctcctgcccctgcgcgctgtcgctggccaccccggcggccctcaccgccgccggcggcagcctggccagcctgggcgtgctcgccactcgcggccacgcgctggaaacgctggccaaagtgaccgacgtggtgttcgacaagaccggcacccttacccacggcagcatgaagctgctggacgtcgccatcgagggcagcctcgcgccggaacaagcgctggcgttggccgccgcgctggagcacggttcggaacacccgctggcgcaggcgctgcggcaagccgccgaaggcctggccgcgccgcgcgtcgaatcgccgctcaaccacccgggccacggcgtggcaggcgtgatggccgggcgcgaatggcggctgggctccgcccccttcatcgccgcctggctgcggcagccgcagcaagacgtcgccgactggcacgccggcagcacccaggtgctgctggcgaatagcgacggcgtgcaggcccgtttcgccatcggcgacgccgtgcgcgccgacgccgccgagctggtggcgcgcctgcgccggcgcggactggccgtgcatctgctcagcggcgacggcgaacaggccgtctgcgcgctggcgcgcgagctggggctggaacgcgcgcgcgcgcgcgccacgccggaagacaagctcgcctacgtcggcgcgttgcaggacgccggccgccgcgtgctgatggtgggcgatggcgtcaacgacgcgccggtgctggcccgcgccgacgtctccatcgccatgggcggcggcactgacgtggcgcgcaccagcggcgacatggtgctgatcgcggaccaattgggcctgatagacgcgtcgctggacatcagccggcgcacgctgacggtgatacggcaaaacctgtgctgggcggcggggtataatctggtggccttgccgctggccgtgaccggccacgtcacgccctggctcgccagcctgggcatggcgctcagctcgctgctggtggccggcaatgccctgcgcctagtcaaacggaagaactgatggaaagcctctacctgctcatcccgctcagcctggtgctggccttcgtcatcggcgccatcttctggtgggccacccgctccggccagttcgacgacatggaaggcccggcccaccgcatcctgatggacgacgacaccccgcgccgggaggacgatcagcagtagtccctcccggcgcgggatggccgcgaattgacaaatcacgattcgcttatataatcgccctcttttttgcgaacagcttcccggcaaccgccgcgccgccaggcgccccgctgcggccatcgcgcccctgccgctgtttcactcccgaagggcatccgtgaataccatccaagcactcgccggcatgttgctgctggtcggcgtagcctatgctttttccacccgccgcgacgccgtcaactggcgcaccgtgctgatcggcctcgccatccagagcggcttgttcctcttgatcaactatatcccggccattcaccacggtttcgccgccttcggcgccggcttcgccaaagtgctgagcttcgccggcgaaggcgccggcttcgtcttcggcgacctggccaaacctggcggcaagctgggcttcctgttcgccttcaccgtgctgccggtgatcatcttcttctccgccttcagcgcgctgctctaccatttcggcatcctgcagcgcgtggtcgccgcgctggcctgggcaatgaagcgcagcatgcgcatttccggcccggaaagcgtggtggccgccgccaatatcttcctgggccagaccgaggcgccgctgctggtccgcccctacatccgccacatgacccgctccgagttggcctgcatcatgatcgccggcatgtcgacgctgtccggcggcgtgctggccgcctacgtcgccttcctgggcgggccggacgccgccgagcaggcgcgcttcgccacctacttgctgaccgcctcctgcatgaacgcggccggggcggtggtgttctgcaagatcatgttcccggaaaccgcccccggcgagctgtccagcaccaagctgcaggcgtccaaggaaaagagcgggggcaatttcgtcagcgcggtggtgaccggcgcgctggacggcatgaaaatggccgccgccgtggccaccatcctgctggccatcgtggcgctgatcgcgctggccaacttcctggtgaaggacggcctgggccagatgctgggcgtcaacgccgcgatccaggcctccacccacggcatgttcgacggcctgacgctgcaatacttggccggccaagccttccgggtgttcgccttcctgatgggaatcggctgggatgagacgctgggcgtcggcagcttgctggggcagaagatcgttctcaacgaattcatcgcctacctcgacctggccaagatgaaggccgccggcacgctgtcggcgccgacggtgatgatttccaccttcgcgctggccagcttctccaacctgtcgtcggtgggcatctgcgtggcgggcatcggcgcgctggcgccggagcggcagcaggagctggcgcagatcggcatgcgcgcgctgctggcctccatcctgaccggcttcatgaccgcctccagcgccggtttgtggctgtcgctattctgatcggcacctgacagtgcggcgggaatcagctagcatgcgattcccgctttttaccagaacggccatccgtgaaagcagatttctcctttttcgccacccggcgcttcctgcccttgttcggcacccagttcctaggcgccttcaacgacaatatgctgaaaaccgccatcgtggtgctgatcagctttcacggcctgaccctagccggcctgccgccggaaatgctggtcaatctggcggccggcatcttcatcctgcccttcttcctgttttccgccagcgccggcaaattatccgagcgttacgacaaggcgcgcatcgccaggctgatcaagctggccgagatcgccatcatgctgctggccggcgccggtttcctgtggcaatcggccgggctgctattgtcagcgctgttcctgatgggcacccactccgctttcttcggcccgatgaaatactcggtgctgccgcaatacctgcgcgaagacgaactggtcggcggcaccggcctgatcgaaatgggcaccttcctcgccatcctgctgggccagctgctgggcagcgtgctcacccacaacggctcgctgctgatcatcgccgcgctgctggtcaccgccgtgctgggctatttcagcagcaccgccatgccggcggtggcgcccggcgcgccgcatctcaagctgtcgtggaatttcctcggcgattcggtgcaactggtgggcaaggcctggcgcatccacgacgtgcgctgctccatcctgggcatttcctggttttggctgatgggcgcggtctacaccacccagctgcccaccttcacccgcatgcacctgggcggcgacgccgacgtctataccctgctgctggcgctgttctccatcggcatcggcatcggctcggtgatttgcgccaagctgtctcacggcaagctgcagctgggcatcgtgctgctgggcagcgccggcatgactgtgttcggcggcgacctggcgctgggcgcgatgcctcattaccacggcccgctggcgacgctggccgaattcatggcccgcgccagcagctggcgcagcatcgccgacgtggcgctgctgggcttcttcggcggcttcttcaccgtgccgctgtacacctggctgcaaaccggcagcccggatgagttccgctcgcaggcggtggccgccaacaacatcatcaacggcttttacatggtggcggccgccatcggcagcgtgctgatgctgaaatggttcgacagcatctcgatgctgctgctggcggtggccgcgctcaacatcctcgccaccgcgcacctggcctggtgcgcgccggacatctggcgccagcgcttcagctggatcgcgccgctgttcgccggcaaggcctgagccgataaaacgacaacgggggcaaacgcccccgtttcgcattgcccgcccggcgcgctcattcgccagccccgtgcgcggcagcctccttctcccccagcagcagcgacaggcgctccatggttttgctgttctccgcgtccggcagcgaaacgaagaagcagatcccgcccgccggcaggttttccgcgtaaatgctgccggcgtgcgccagggcgatctgccggcagatcgccaaacccagcccggtgccgccggaaccgttggcggtggcgctgctctgcacgaacttgtcgaaaattcgctccaattcggcttccggcacccccggcccctgatcggccaccgacagggtgacgatggagccgaaatgctgcagaccgatgcggatccggccgccatgcggcgagaacttgatcgcattggacagcagattggccaatatctgctgcatggacttgcgatccacccaggcgagcagcggcagcggcggcaactccagcttcaagccgatgcccgcctccgccatgcgcccctcttccgcctgcgtcatcaggcggaccagctcgcatagatccacgtcctcgcggtgcagcgccatgcgccccgactccagcttggccagatccagcaaatcgttcagcaagaccagcagcctggcgccgctggcatggatattgtcgaaatagcgcttgatccgctccggcggcgcctgcccgaccttgtcgccgccgatctcggcgaagctgagtatgccgtgcagcggcgtgcgcagctcatgcgacatattggccaggaattccgacttggcctgattcgcccgctccgcctcctccttcgcctgcaacaagtcggcggtgcgttgcgcgaccagctcctgcaaatgattgcggtggccgtacaactcttgctccgaccgcttgcgttcggtgatgtcgcggccgacgccgcgatagccgcacagctcgccgtccgcgctcagcagcggacaggcgttgatggctatccagcgctcctctgcgcgccgccggtagctcagctcgaaatcccgcacctcttggcgcccggcgaacagccgcgacagccgctcagcctggtcgcggttcgcgcgcaccggccgccactcccgccagtggcggcctagcagcttgcccagcggcacgccggtcaattcgctgaaatgctcggaacagtagctgagccgtccttcggcatccagctcccacagccagtccgaggcgatgctggcgaacatgcggaaacgctcctcgccctgccttagcgcgcgggcgcttcggctggccaactcttccgccacctcgcggcgccggtgcagcaggttcaagtaaatgccgagcagcagcgtgaaccccatgccggccggcaacaccagcagcgccgcatggctgccgctggcctccaggtaacgcggcagcgcgcgcaaggtcaccttccagacccgcccgcctatcgccagcttgcggctcagccacgggcttcccggactcgctcgctgcgtcggcgccaccaggctgaccgtgccgccgccgccgacatcgtccagctgcagactgatccctttttcagccagcgccgggagggcccgcgccgccagccgggcggcgttgatgccgcccaccaccacgccgccgcggacgccgggcacaggaatgatcatcgacacccccttgccggagtcgtcgttgaactgggccaggatcagcggctcgctgatcctggcctggccgctggccagcgcgcggcggatggcttcgcgccgcctgggctccgaccacaggtcgaaaccccatactttcggattgtcttccttgggcgcgatataggtcaccggatagtattcgggccggatgccggcggcgacaatgcggccatcggcccgcttctcgcggaccttgccgtacttcgcctcataagccggccggccggcctgcggcaccagcggcgcccagcctatcccttgaaacagcggccggctcgccaccagcggcctggcgaaacggtagaaatcatcctggcggatattgggcgcgttgcccatgaaaagcgccaatgagtccagcgcgtcgacatcctgctggatcgcgctcgccagttgctcggccgccgccccggcatcgtggcggaaattggactcggtcgccgcccgctcagccctgtcgaaatgacgcgacaatatgacggtgagcaacaacggcgccagcaggatcagtccctgcacctcgcgccgggccaccatgcgccggcagcgcgccgcgccggcccgcgcgcgcggccagcgccacaagacaccggccagcgcagcgctcttcgccggccagccttggctcacctcaaactcccgctaaagcgaaaaccccgcgccaacgcaaagccggcacggggttttcgggacggggctccagccccgctctgggcggcgaaggacatgaatcactccaagcgcgatgcttatggaatattcatagccgctgcggcctcacttaggcaagcgctatcgcatccagcttcgccttcgcgtcgcgcagagcggtgcgcaagccttcttctatcaccgggtgatagaaaggcatttgcagcatttgcgccaccgtcagctgttgctgatggctccaggccaatagatgcgccagattctccgcccgcgggcctatcatctcggctcccaggaagcggccggtttccttgtccgcgtatacgtgcaacaggcctttgttgatccccatcacccggctgcgcccctggtcctcgaagctgacctcgcccgccacgaaaccctcgtcggccagatcggcgaaacggcggcccaccatcatcatctgcggatccgaaaacaccaccgcgataggcgaacggcgcaatccggccgtcaattgcgggtaagacgcggcattgccgccggcggtagcgccttcgtcggccgcctcatgcagcaaggggaggatatcgttggcgtcgccggcgatgaagaccggcgcgccgacgcacagcagcgtttccgggtcgaacatcggcacgccgcgggcatccagcagcacgctggtattctccagaccgaggccgcgcacattgggggcgcggccggtggcggccaacacataatcgaagcgctcctccacctccgcgccgtccaggctcacatagcggatccgcgccgcgtcgccatcattggccatttccagcaccttggcgtccgggtccaggtaaaactcgttgcccagcgcctggcgcgcatagtcgcgcaccgccggatcgctcaagggtcccacgccgccgcgggcgccgaataccttcaccttcacgcccaaacgcgacagcgcctgtccaagctccaggccgatgacgccggggccgaacaccgccacgctttgcggcaggtcttcccaatcgaacacgtcatcgttgatgatcaggcggtcgccgaaggcctgaaacggcggcgggatcaccggcgacgaaccggtggcgatcaccacgcgcttggcctgtaccaaggtatgctcgtccacctgcaaggtggtgttgtcgatgaagcgggcatagccgcgcagcttgtcctcggtcggaatgccatccacgcttcgcaccacgaagccgacgaagcggtcgcgctcgctcttgacgcgagccatcacttcgcggccgtcgatgcgcacctcgccatccacatgcacgccgaacatatctgcatggctcgcatggtgggcggcctcggcggcggcgatcagcagcttggacggcatgcagccgacgcgggcgcaggtggtgccgtaaggcccgccctcgatcacgatggcggaagcgccgccggccttggcggcgcggtaggcggcgaggccggcggtgccggcgccgatgacggctacgtcgatatggatggttttcatggttttatccttgtatctggcagggatgcggcacgccacgcacgcatggcgtcccgcatcccggcaaaaaaggcggccggcaggagtaccggcccaaaagaaccggcggcgtcagggcccgagccgccggaaacgaacaccttacttggcgaagcgcttttccacttcgtctgccgagccgatcagttcgccgttgatgaacacttgcggagcggtcatcttgccggacaccgcgcccagcgccttgccgcggatcttgttgtccagcggcacttcgacgaagtcgtagccgttttcggccaacacggccttggcgcgggcgcagtgcgggcagcccaccttggtgaacaccacgacctggtcgggcttcttggcgttggggttgatgtaattcagcatggtgtcggcgtcggacaccttgaacggatcgcccggctcttgcggctcgatgaacatcttctgcaccacgccgtccttcaccagcatcgcgtagcgccagctgcgcttgccgaagcccagatcggccttgtccaccagcatgcccatgccttcggtgaaatcgccgttgccatcgggtatcatcacgatgttggcggcttcctgatccttggcccactcgttcatcacgaaggtgtcgttgaccgacacgcacaggatggcgtcgacgccgttggcgtagaatgccggcgccagttcgttgaagcgcggcaggtgggtggacgagcaagtcggggtgaaagcgcccggcagcgagaacagggcgatggtcttgccgtcgaacagttcggcggtgctcacgtttttccactcgttgttttcgcggatgcggaaagtgacgttcggtacgcgttggccttcacgattttgcagcatggtcagctccttgtggggtgttggttgtttgctatcgatgaatgcattctgatagccagcaccaaaaaggtctaattgattgttgcaagatttttgattgtctttttcaatgactccgccccgcgctgggcagcccgccgcccgcgacgttaaaatgccggcatccggcaactgcctcgttcaacgaccatgcatatcagcggcctgcatcatctcgccatcatcgcctccgactatgcgcgctcgcgcgacttctaccaccgcgttctcgccctgcccatcgtggcggagaactggcgcgccgaccggcagtcgtggaaactggacctggccctgcccgacggcagccagatcgaactgttcagcttcccgcaaacgccggcgcgccccacccggcccgaggcctgcgggctgcgccacctggctttcgcctgcccggacatagacgcggcccgcgcgcacttgctggcccagggggtagaggcggaagcgatccgcctggacgaatacaccggctcgcgtttcttcttttgcgccgacccggaccgcttgccgatagagttttaccaggcggcgcatgccgaccgcccgacatgaccaacatgccgggcgcgcccgccttcatatttcgccattggctgtcatagtgaattatcgaaccgccggcgccagcgccgcgccggcggcaatccacccgaaaacggaatgcttatgaatatctctaacacgcctgccctcctggcaggcttgctggtcgccctcggcaccgcggcctccgcgcacgcgggcgccgacgacaccctgctggcggcccgcgacgccttccgcgccaatgaactgggcaggctggccagcctgggcggcagcctgccggacagctatccgctgaaggattacccttcctactggctggcctggaaggcgctggaaaaaaacgacgacgcccaggtgacgcgctttctcgaacaggtgccggaaggcctgatgccggagcggatacgcaacgaatgggtgaagaagctggggatgcgcgaaaactggaccgctttcgccgccgaatggaaaaagctgccggaggaaggccgcgacgaggagtccagctgttatggccaactgatggggctgtaccaggggcagaagcccgacaacctcgaccgcttcctggagggcaagccggtcccggacggctgcaaccgcctgatcgaaggcgcgtacgcccgcggactgatcaaccaggactggctgtggcgccgcgcccgcctgctgctggccggcaacttcgtcagccaggcgcgccagttggccgccgacacccagctgccgctggacaacgccgcgctcaacaagccggccaacgccaatttgtccactccgggcggccaggaagccgcgctgctggaaatcgagcgcaaagcgaaaaccgacttggacggcgccgccgccagcctgtcccgtctggaaggcaatatcgacgccgaccgcagcggcttcggctgggggcagttggcgctgctgtcggcgcgcaagcagctgtccgcccaggcgctgcaatggttcgacaaggccgatccgcgccagctcaccgccgaccaatgggaatggtgggcgcgctcggcgctgcgcctggagcaatggacgcagctggacggcatcatccgccggatgccggcggcggtcgcggcgcgcccggcatggcgctactggctgggacgctcgctgcagcagcagggcaagccggcgctggccgcgccgctgttcagccaggccagcgtcggccataactactacgcgctgctgtcgctggaggaactgggcaattcgctgtccgcctccaccaataaaaccatgcccagcgccgacgatgtcgcgcggatgaagcaggaccccgccattcgccgctcgctggccttgctgtcggtggccgaaatctacaccaagcccgaattccgcaccgacgcgcagcgcgaatggcgctgggcaatgcgcggccgcaacgatatggaactgctggccgcggcggaaatcgcccgcaaggaaggcttttacgacatggccatctacagcgccgagcgcaccaaggaagagcatgacttctcgctgcgctacctgacgccctaccgcgacatcacccagaagtacgcgcgccagctcgacatcgacgacgcctgggtctacggcctgatccgccaggaaagccgcttcatcaccatggcgcgctccggcgtcggcgcctccggcctgatgcagctgatgccggccaccgccaagtgggcggccaagaaaatcggcctcacccatttcgccgtcaacgacatcgacacaaatgtccagctgggcacctggtatctgcgctacgtgctggacaacctgtccggcaatcaggtgatggccaccgccgcctacaacgctggccccagccgcgcccgcaactggcagaccaaccgcgcgctggacggcaccatctatgccgaaaccataccgttcagcgaaacccgcgattacgtgcaaaaagtgatggccagcgccgcctactactccagcaccttcggccacgccaatatctcgctgaaaaaccgcatgggcatgatccctccgcgctgaaccggaaccaaccgtgatgaaccagacaattgccccactcccgcaaaagatctgcctgataggcggcagcggattcattggccgccatctggcggcgcggctggccggggacggccaccgcatcaccgtggccagccgcaaaaccgcgctgcctgaattcctggtgctgccgtcggcgcggctggtgaacgccgacattcacgaccccgcgcagctggaggcgctgatctccggccacgacgcggtagtcagcatggtcggcatcctgcacggcagccgcgcccagttcgaaaaaaaccacgcgcgcctgcccgaagccatagtcgaagcctgccgccgccagcgcgtgccgcgcctggtgcatgtcagcgcgctgggcgcggcccaggacgctccaagcgattacctgcagaccaaggcattgggcgagctggcggtggaaggcagcgggctggactggaccattctgcgcccctcggtagtgttcggccgcgacgacgccttcctcaatctgttcgccgcgctgcagaaacggttgcccttgctgccgctggccggcgccgccagcaagatggcgccagtatgggtggaagacgtggcgcgggcggtgtgcgccagcctcggccggccgcaaaccctgcgccgcaagctggacctggccggacccgagatttacacgctggcagagctggccagactggccggccgctgcagcggccattcccgtccggtcatcgggctgcctgacagcctggccatgctgcaggccggcctgatggaacggctgcccggccccacgctgatgagccgcgacaatgtccgttcgctgcgttgggacaatatcagcgagcatccctttccgtccgggccgctgggcttcgcgcccaccccgctgtcggcgctggcgcccgcctggctatcaggccgcgacggcaatcatatcgtctcccgctaccgggaaaaggctgcgcgttaagatggacatttatatcgtcggcggcgcggtccgcgaccgcctgctgggcctgccggtcaaggaccgcgactgggtggtggtgggcgccacgccgcagcagatgctggaccagggtttccgcccggtcggcaaggactttccggtattcctgcacccgcaaacgcaggaggagtacgcgctggcccgcaccgagcgcaagatagccaagggctaccacggcttcgtatttcacaccgatagcggcgtgacgctggagcaagacctggcgcggcgcgacctcaccatcaacgccatcgccgaagccggcgacggcagcctgatcgatccctatgacggccaggccgatctgaaggccggcattctgcgccacgtcagcgacgccttcgccgaggacccggtgcgcattttgcggctggcgcgcttcgccgcccgcttcgatttcgccgtcgcgccggaaaccatggcgctgatgcggcaaatggtggacagcggcgaagccgatgccctggtggccgagcgggtatggcaggaactggccaagggcttgatggaagacaagccttcgcggatgctgctgacgctgcgagaatgcggcgcgctcgcgcgcgtgctgccggaagtggatgccctgttcggcgtgccgcagcgcgccgactaccacccggaaatcgattgcggcgaccacaccatgcgggtgctcgattacgcggccgccgccggctacccgctggcggtgcgcttcgccgcgctcggccacgacctgggcaaggcgctgacgccgcccgaggtgctgccgcggcatatcggccacgagatcaacggcacccggccgctggccgaactgtgccgccgcctgcgcgtgcccagcgactgccgcgacctcgcccacatcaccatggtcaaccacaccaaggtgcatcaggcgcaggagttgcggcccgccaccgtgctgcggctgttcaaggacagcgacgccctgcgccggcccgaccgcttccgccagatgctggacgcctgcctcgccgacgcgcgcggcaggctgcatttcgaaaccgcggcctacccgcaaaaggactacctcgagagactgctggctgctacgctgcaaattgatgccggcgccatagccgccggctgcagcgacaaggccgcgattcccgccacgctggatgcggcccgcaccgccgtcatcgccgactgcaaggagcaatgggaggaccgctgatggatgcgctttaccgcctgccggccatgctgatgcgcggcggcaccagcaaggggctgttcatccgcgccgactcgctgccggaagacaccgagcaatgggaagccatgctgctgcgcgccctcggcagccccgatccctacggcctgcagatggatgggctgggcaccgggctggccagcagcagcaaggtgatgatactcagcccctcgcgccgcgacgattgcgacatcgactgcctgttcggccacgcctccatcgccgacgcgcgcatcgactggtccggcaactgcggcaacctcagcgccgccgcgccgctgttcgccatgctggaaaacatggcgcgtcccgcggacggcgtcgccaccatcgccatctggcaagccaatgtcggcaagcgcatcctggccgagctggaagtcttcgacggccagccggtgtggcagggcgacttcttcatcgacggcgtgtccttccccggcgcgccgatccggctgcgcttcctcgacccctgcggcgtcagctcgggcgagctgttcccgtccggccggctgatggacgagctcaaactgcccgacggcagccacatcgaggccacgctggtggacgccggcaaccctaccgtgttcgtgcgggcgcgcgacttcggcctgagcgggcgcgagccggccggaccgatgccgctggccacgctgcgccggctggagctggcccgcgccaccgccgcagtggcgatggggctggccgaagacatcttcgccgccgaacgcgagcggccggcctttcccagaatcagcttcctgtccgccgccgccgatgccgaatgccagctcaacgcgcggctattgtcgatggacagggtgcatcatgcctattccggcaccggcgccatcgcgctggcctgcgcctgcgcggtcgacggcaccctgccggcggagctggccggcggcgcggtgcgaggcatgccgctcactttcagccacgccagcggcaagcagacgctggaagcggtgctgggccgcgcggagttggggtggtcggtcagcgaggtggtgatgacgcgcaccgccaggccgctgatgcgcggcgaggtctacatcccgccagcctgagtccatgccattgacgtgaattgaccatttccgccacgccaggcgggatgctctcttgcctgaaagcccccgaaaatcaagccccctcccccgccgcccggcgggacaaagaaataagcccgcagttcctgttcattttttttatttaaaattgtaaaatttcggccctaactatcatctatgcaacaaaatcggctgccgcgcagtccgaatggaaaaccgaacgcccgatgtcatccgctttgcatttcacaatcgacagcctgatcagctggcctccggccccggatgtcgacggccagaccagccacccgccgctggagccggtccccgccatgcagcggcggcgcatgagcccgctgtgcaaggctgccatgcatggcgcgttcggcctgggcgacggcggcgacgacattcccttggtattcgcatcgcgcttcggcgacatgtcccgctccatcgaactgttgcagcaactcagccagggcgagtcgctctcccccacccagttcagcctgtcggtgcacaacgccatcggcgcgctgcacggcatattgtccggccatgccggacagtacacggcgatcgccgccgccgaagaaaccgtggaggcggcctgctgcgaagcattggccatgctggtcgacggcgcgccggctgtgcggctggtggtttacgacgccccgcttcccgcgccataccaagacgccgcgccggctcagccgccgctcatcgcctgggcatgccggctgcgcctggccgacagcggcccgcgcttcagcctggaaagcgcgcctgccagcggcgacgccgacagccaagggctgtggccgttcctgaacagcgctgcccggcagcatacccaccattgcggccaacgcgactggcattgggcccgacatggctgaacgctgcaattatttgtggcgcctgatggccaccgccatcgccttctccgtgttcggactgggcggcgtgctgttctcgctgatcgtctttccgctgctgatgctgctggtgcgccgcccggcgcgccgcatcgccttgtcgcggcgcgtggtccagataagcttcgcggccttcattcaattgatgcgcgcgctgggcattctccgctaccgcatcgtcggcgccgaaaaactgcggcgccccggcctgctgatcctggccaaccaccccacgctgatagacgtggtattcctcatttcgctgctaccaaatgccgactgcatcgtcaagtcgtcgctggcgcgcaatccgttcacccgcggcccggtgcgcgcctccggctacatttgcaacgattccagcgaagggctgatcgaggactgcattcactccgtccacgacggcaacaatctggtgatcttcccggaaggcacccgcacgccgctggacggccgcttcacattgcagcgcggcgccgccaatatcgccgtccgcggccgccgcgccatcacccccgtgtccatccgctgcgaaccgcgcagcctggccaagggcgtgccctggtggcggattccgccgcggccgatgcatttcaccatcgaggtgctggacgacctgccggtcgcgccgtttctcgaggggcagagcgaagccatggctgcccgcaaactgacccgtttcctgcacgacttttaccttacgacatcgagccttcatgcaaaccctggaacttgagatcaaaaacctgttgatcacctccttgaatctggaagacatcacccccgacgacatcgtcgccgacgccccgctgttcggcgacggcctgggcctggactccatcgacgcgctggagctgggcctcgcgctgcagaagcgctacggcatcaccctgtccccggacggcgaggaaacccgccgccatttcgccagcatcgccagcctggccggcttcgtcgccagcgcgcgcaagctgtaaccccacttccggagaccgccatgaccaaagacgaactcttcgcgcgcctgagcgctgtgctgcaggacacttttgaaatcgaagccgacgccatccacccggaagcgcgcctgcgcgaagacctggacatcgacagcatcgacgccgtggacctgatcgtccagttccgtccgctggtgggcaaacgcctgcagccggacgtgttcaagtcggtgcgcacgctgcaagacgtagtggacgccctccacggcctgatgcaggaaaacgactgagcgatgcccgccaccgcgctggccagcctgctgaccctgagctaccccttcctgatctatttcggccagggacgggtggagccgcgcctgctggcgggcgtgctggtcggcatcgccctgctgcgcgcgctcagcacgcgccaggcggtctggtactgggccgccgccgccacgctgctgctggcggcgttcagcatgctgggcaacggtttgctgccgctgaagctctaccccttgctggtcaatgccgtcctgctggcgatgttcgccggcagcctgcgcttcggcccgccgctgatcgaacggctggcgcggctgaccgagccggagctggacgcgcgcgccatacgctacacccgcgccgtcacccaggtctggtgcggctttttcatcgtcaacggcagcctgtcgctggctaccgcgctctgggccgacaacgccgtctggaccgcctacaacggttgcatttcctatctgctgatgggcgcgctgttcggcggcgaatggctggtgcgccagcgcgtcaaatcccgcaataccactcatggctgatttcattcccctttcgcgactgctggccgtcggccgcggcgcaggccaccccgtcgcccgcgacggccagcggcattacagcttcgccgatttccgccaacgcgccgcgcgctggcgcgccggcctgctgcgcacgcgccagcacgtagtggccatccatctggacgacagcttcgagttcgccgccgccctgtttggcgcctggcacgcgggcaaaaccgtctgcctgcccgccgacgacctgccggccacccgcgccgcgctggccgaacgcggcatgctgctggatgcgcagccggccgacgcggacgactacgccgatttcggcgagctgtccgaagacggctgccggctgcagctgttcacctccggctccaccggcgagccgcaggcgatagacaaaggcctgcgccagctggcggcggaaaccgccatcttgtcgcggctgtgggacgacgcgctgcccgccggctgcctggtggaagccaccgtttcccatcagcacatctacggcctgctgttccgcgtgctgtggccgctggccgtcggccgccccttcgcctgccggcgccagaccttcccggaaaacctgctgcaggcgctggcaaacgagccctgcctgctggtcagcagcccggcccacctgaaacgcctgccggccagcctcgactggacaagcgcagccggcaagctggccgccgcgttttcctccggcgggccgctggacgacgccgcgctggccaacagcctggcgacgctgggacaggcgccgtgcgaaatcttcggcagcaccgagaccggcggcatcgcctggcgccgccgccagaccgacgccgcccagccgtggcagccgctgcccggcgtgcaagtgcgcctggacgacggcctgctggccatccgctcgccccatctggacgatgacggctggcatcagacccgcgacaaggcggcgccgcagggcgagggctttgtcctgctcggccgcgccgaccgcatcatcaagctggaagagaagcgcgtgtcgctggacagcgtggaggccgctctgttggccagcggcctgttcgacgccgtgcgcctggtgctgctgcccggctcccgcgacacgctgggcgtggccgcggtacccaacgccgcgggctgggagcgactggccgcgctcggccggcgcgaattcgccgcccgcctgatcaccgaactgaagcgcagcgtgatcccggaaggcctgccgcggcgctggcgctacggcttccgcctgccggtcaacgcgcagggcaagaccacccaggcgcagctgttgtcttggttcgaggcccgccgcccccacatcacgctgctgcgacgcgacgccggctacgcgctgctgtcgatagaagccgccgccgcgctgccggacttcgccggccacttccccggcttcccgctgctgcccggcgtcacccagctggactggagcgtgcgcctcgcccgcgagctgttcgacctgaccggcttcagcggcatggacaatctgaaattccagcgcatcatcgcgccggacagcacggtgcggctggagctgcgctacgacagcgacaagcgcagcgtcagcttcgcctacgattccgacggcgagccccacgccagcggcaagctgcgcttcggagccccggcatgctgatctgcgcggtagtgccggtatacaaccacggcggcgcggtgggcagcgtggtggcctccttgcgcgcgcaagcgctgccttgcgtgctggtggatgacggcagcgacgccgactgcgccgcggtgctggacgcgctggccgccgccgacgaacacgtgcggctggtgcggctgccggaaaaccgcggcaagggcggcgccatgatcgccgggctgcgcgccgcgcgcgagctgggctacagccacgcgctgcagatagacgccgacggccagcacgacagccgcgacatcccgcgcttcctggagttggcccgcgcccagccgcaagccttgatctgcggctgcccgctgtacgacgaaaacgcgcccaaaagccgccgctacggccgctacgccacccatgtctgggtatggatcaacacgctgtcgctgcagatcgccgacgcgatgtgcggcttccgcgtctacccgctggcggcgacggtgccgctgttcgaccaggcgcggctgggcctgcggatggatttcgacgtggaagtgctggtccggctgagctggcgcggcatgcgcatcgtcaacctgcccacccgcgtcagctacccgctggacggcgtgtcgcacttccagctgtggcgcgacaatctgcgcatcagccgcatgcacgccaagctgttcttcggcatgctgccgcggctgcccctgctgctggcccgcaaggcggcgcgatgaagccggcccgccattgggccggcatcggcgaaaacactttcgtcgccggcatcgtgctgctgttctgggttcaccgcctgctggggcgccgcctgttccgcctgtgcctgctgccggtggtggcctgctactggctggcatgcgcgccggcgcgcgcggcctcgctgcaatacctgcgccggctggagcggcactgcggcacgctgggccgccagcccggcgcgcgcgacaccttccgccatctgctgcgcttcgccgacaccatgctggacaagctgcttgccaccgccggccactacccggccgaccgggtggcgatcagcggcgccgacgtcatcatcgacggcctgcgccagcggcgcggcgtcttgatcgtcaccgcccatctcggctgcctggaactgtgccgcgcgctggccgaccgctcgcccgacgtggtggtcaacgtgctggtgcacacccgccacgcccagcgtttcaacgcgctgctcgaccggctcaatccgcagcagtcggtgcggctgctggaggtgaccgaggtcaacgccgccaccgccgtgctgctggaacagagaatcgccgccggcgaggtggtggccatcgccggcgaccgcgtgccggtcagcggcgaccgcacggtgagcgtgccgtttctgggcgaaccggcgccgttcccctgcggcccctatctgctggcccacctgctgcgctgcccgctctacctgatggcttgcctgcgccagggcgcgggctaccacttgcaattcgtgccgctggccgagtccatccgcctgccgcggcaaaaccgcgaagcggcgatcggcgaatacgccgcgcgtttttccggcgaactggcccgcctgctggccgcctcgccctacgactggttcaattttttcccgttctgggatcagaaatccaaatcatgacccccaagcatcaagattctgtaatattcgatggctcctggctgtcgctggacgacatccacgccatcgccatcggcgccaagcaggcgcggctgtccgatgacccggcgttctgcgagcgcatcgaaaaaggcagccgcttcatcgaccagctgctggccgaagacggcgtggtctacggcgtcaccaccggctacggcgactcctgcaccgtggagattccgcccgccctggtgcaagaactgccgcaccacctgtacacctaccacggctgcggcgccggccgctttctcgacgcggtcgaaacccgcgcggtgctggcgacccggctggcctcgctgtgccgcggcgtctccggcgtcagcctggcgctgctgcgccagctggccgcgctgctcaagcacgacatcctgccgctgattccagccgaaggctcggtcggcgccagcggcgacctgaccccgctgtcctacgtcgccgccgcgctgtgcggcgagcgcgaagtgacgcaccgcggcgagcgctgcgccgccgccgacgcgctgaaggccgccggcctcgcgccgctgcggctgcgccccaaggaaggcctggccatcatgaacggcaccgcggtgatgaccgcgctggcctgcctcgcctggccgcgcgccgactacgcctcgcgcctgtgctcgcgcctgaccgcgatgaacgtggccgccgccgccggcaacgcccaccatttcgacgaagcgctgttcgccgtcaaaccccaccccggccagcaacgcatcgccgcgcgcatccgcgccgacctggaagccccgcgccccagccgcaacgacagccggctgcaggaccgctactcgctgcgctgcgcgccccatgtgatcggcgtgctggaagacgcgctgcccttcctgcgcggcctgatcgaaaacgagctgaacagcgccaacgacaaccccatcatcgacgccgacgaagagcgcgtgctgcacggcggccacttctacggcggccacatcgccttcgcgatggacagcctgaaaaacgcggtggccaatctggccgacctgatggaccgccagatggcgctgctggtggacacccgctacaacaacggcctgccgcgcaacctcagcggcgccagcccggagcgcgcgcctatcaaccacggcctgaaggcgctgcagatcagcgtatcggcctggaccgccgaagcgctgaagcagaccatgccggcgtcggtgttctcgcgctccaccgaatgccacaaccaggacaaggtcagcatgggcaccattgccgcccgcgacgcgctgcgcgtgctggagctgaccgaacaggtgctggctgccttgctgatcaccgcgcgccagggcgtggagctgcgcggcgaaatcgccgagctgtcgctgagccccgcgctggagcggatgcagcgggacctggccgcgcgcattccgcgcatcgccgaagaccgcgcgctggaccgcgagctgcagcaattgctcgccgccatccgcgcgcaagcctggagcctgtatgcctgatctgtcgcacgccatagcgctggacccggccttccacgacctcgacccgatggacgtggtctggcacggcaactacgtcaaatacctggaaatcgcccgctgcgcgctgctggagaaatacggctacaactacccgcagatgcgcgactccggctatatctggcccatcgtcgacatgcggctcaaatatgtgcaatccatccgcttcggccaaaaggtcagcatcgaggcccgcatcgtcgaatgggagtgccggctgaagatcgaatacctgatccgcgacgccgccaccggccacaagatcaacaaggcctacaccgtgcaggtggcggtggacatcgccagccaggaaatgctctacctgtgcccgccggtgctgtgggaaaaactgggagtgcccgcgccgtgaagaaactcgtcctgctggccggcctcgcgctgctgccgctgaccgccgccgccggcgatctgatcgccgacatcacccgcaagctggcgcagccggccgtgctgcgcggcgcgttcgagcaaagcaaggagatcgccggcttcgccaagccgctgcgctccagcggcgctttcctggtgtcgcgcgagaaaggcgtgctgtgggatacccgccagcccttcgccagcaagctcaggctgacccgcggcgagatcgtcgccacccagaacggctcagtgtcatttcagctgagcgcggccaaagagcccaccgtgcgcaccatcaacgagctgatgttcgcgttgctgggcggcaacctgaaagcgctggacggctatttccgcatcgacggcaagctgtccggccgcgcctggcagctgacgctgacgccgcgccagagcgcgctcgcccgcgtgatgcaaaaagtggagctgtccggcgaccaatacgtgcgcgccatccgcatggacgaagccaacggcgacgtcacccgcatcgtgttcagcggccagaaccccatgcccgccaagctgagcggcgaggaagaggcgcgctttgactgagcatctgggatccagccgtccgcaacgctggctggccgccgtctggctggccatcctgctggccgtggccggccataacggctggctgtggctgggcggccacgcgcggctggaaaccgacatcctggcgatgctgccgcaaaaccgccaggaccaggcggcccaggacgccacccgccagctggccgacgccgccgcgcgccgcgtggtggtgctggtgggcgcgcgtgactgggccgacgcccgccgcgccggcgacgcctacgccgccgccatccgcgcatccggccagccgctggcgccgcgctaccgggtgggcgcgcaggaaagcgacaactggctggacttctacgccgcctaccgcggccagctgctcggcgacgatacccgccggcaactgcggcaaaccgcgcccgccgcgctggcggaacaggccgccgccgccttgttccagccagtgggcatgcccaggctgggacgctggcaggacgatccgctgaatgtctacggccaatggctgggcgagcgcgccgcgcaaagccgggtgcgggtgcgggacgagcgcttgtcgctgtccggcgccgacatgcagtacgcgctgatcatgctggagcagcaaggcccggcgttctcggtggcggcgcagcaggcgatgctgccggcgctgcgccaagccgaggccgccgcccgccaggcggtcccgcatgcccagatcatccagggcggcgtgccgctgttcgccgccttcgccgccagcgccgccgagcgcgaagtccacaccataggactgggttccttgctgggcattctgctgctgacggtgctggccttcagcggcattcgcccgcgcatcctggtgacgctgtccatcgccgccggcctaggctgcgccatttcgctcacctcgctgctattcggcaagctgcacctgatcaccctggtgttcggcgccagcctgatcggcgtggcggaaaactacggcaacaattactacgcctatcggctgggcaagccggccggcgagcgctgggcgatgctgcgcggccagcgcgccaccatgtggctggccttcgccaccaccgccatcggctacgcgctgctggcgctggctcccttccccgggctacggcagatggcggtgttttccgtgaccggcctgttcggcgccttcgtcaccacgctgtgctgcctgcccttcgccgaccgcggcgagatgccgttcaaccgcttcgcccgcgcgctgggcggctggcgccggcgctggccgcgctggggacgcaaccgcttcagcctgctgctgggcctggcgatggccgccgcgctgctggccggcttcgccgtcctgaaaaccaatgacgacatccgcgcgctgcaaaacgcgccgcaaagcctgctgcaggaccagcgccgcatcggcgaactgatggaaatggccggcccggcgcaattctacctggtgagcggcgacagcccggagcaggtgctgcgccgcgaagaagcgctgaaaacccggctggcgccgctgatcgccgccggccagctcaagggcgtgcaggcgatttccgactgggcgccgtcgcaggcgcgccaactggcagaccggcgattgctgcaacaaacggtgttcgcgcccggcggcgtgctggcgctggcctccgcccgcctgggccagcctgccgccgccgcgccgccgcccgccgccttccagccgctgacgctgcaggcctggctggccgcgccggtgtccgaacccttgcgcgcgcaatggctgggccgcttcggccagggctacgccagcgtggtgatgctgcgcggcctggccggcccgtccatactgcccttgctggcgcggcaggccgaacccgccgccggcgtccgcttcatcgacaaggccggcgaggtgtccggcctgatgcggcactaccgccagttgatgagctgggtgatcgccgccagctacctgctggtgctggccatgctgtggcggcgcttcggccgccaggcctggcgcgcgctgctgcccacgctgctggccagcctgctgaccgtggcgctgtcggcgctgctggggcagccgctgcagctgttcaccatcctggccctgctgctgattctgggcatgggggttgattacggcgtgttcctgctggccgacgacgatccgcgcgcctttctgtcggtgacgctggccgcggccggcaccctgctctcattcggcctgctggcgctgtcgtccaccccggcgctcaccgccttcggcctgaccatgctgctgggcatcagcctgtgctggctgctcaaccccctattcaccccaaaaacataaaagaaataaagcgaagacatggaaactggctctcaaaccctgcaagacaaaagcttctctcccgcgcgccaaagcgtgatggacgcgcgtttcgaagcgcaaaagatcgccttcggcccggtcgtgttccaatgtgtgcgcatcgcctggaagcgcggcatcctgaaagccctggccgaagccggcgagaagggcctgtccatcgccgagctggccgccgccggcgacttcaccgtctacacgctgaagctggtgctggaaacctgcctgtccgccggcgtggtggagttgcgccagggccgctacgcgctggacaagaccggcttctgcctgctgtccgaccccatcacccagatcaacctcgacttcatccatgacgtctgctaccagggcctgttcgagctggagcgttcgctggacgaggaaaaaccgcacggcctggccgcgctgggccagtgggacaccatctaccagggcctcgccacgctgccggagccggcgcgcgaaagctggctgcgcttcgaccacttctactccgacacctcgttcccggccatcctgcccgacgtgttcgccacgcgcccgcgcaagctgatggacatcggcgccaataccggcaagttcacgctggccgcgctggcgcacgacgccgaggtggagatgcacctggtcgacctgccggggcagctggcagtgatcgaaaagacgctggcggaaaaaggcctgagcgcgcgcgccaacctgcacccgatagacatgctgaacccggcgctggacttccccgccggcatggacgtgatctggatgagccagttcctgtcctgcttcagcgaggaggcgatcgccagcatcctgcgccgcgccgccgccgcgctggccgacggcggccgggtgatgatcctggacacgttgtgggaccgccagcagcacgacatcgccgcctactgcctgatcaacacctcgccctacttcaccgcgatggccagcggcaacagcaaggtataccgcgccgacgactacatccgcctgtgcgaagccgccggcctgaaactggtgcaagagcgcgacggcatcggctattgccactctctgctgcagttcgcccgcgcatgatccgcctgcgccgcctcctgcccctgtgcctgtgcctggttctgctggccggctgccagagcgcgcccgcgccgcagccgcgcctgccggccatcgccctgtcgccggccagcctgggcctcagcctgagcctggcccagcgcctgagcgcggcgccgctggacccgcgcgacggcacgccctcgccggcgctggacgtgcagctggaaatcgacggcgaccggctgcaattggccggcctggcgctgggacagcgcatcctgcggctgagttgggacggcaagacgctgcaaagccagcgcagccccttgctgcccgccagcgtcgacgaagcgcgcatcgtgcgcgacatccagctggcctactggccgctgccggccttgcgcgcggcgctgccggaaggctggacgctggagcagcgcggcgcgacgcgcgtgctcagccagcagggggaggaagcggtgcggatagacagccaggccgacccggcctggaccggccacagcgaattgatcaatcggcgcgaaggctatcgcctgagcatagactccgcgccactgcagtaaagatgacgccatgacgaacgccgtctatctcaaccacctgggagccctgtgcagcgccggccgcggccacgccgcgctgcgcgaggcattgttcgcgccgccggcgcctattcggcggcccggcctcgcgctgcccgatggccgcgtctggcctagcgcgccctatcagcaggcgctgccggacgtggactggctgccgctgccgctgcgcagccgcaacaacgcgctgctgctggccgcgctggaggatatccgcgccgaagtggacgcggccatcgcccgcttcggccccgaccgggtgggcgtggtgctgggcaccagcacctccggcataggcgagagcgaagccgccttcgccgcgctgcggcgcgacgggcgctttcccgccggcttccatccgctgcagcaggaactgggctctcccgccgccctgctgcgccacgcgctgggcataggcggcccggcgctggtgatctccaccgcctgctcgtccggcgccaaggccctggccagcgcggcgcgcctgttgcgttccggccagtgcgacgcagtgatcgccggcggcgccgattcgttgtgccaattcaccgtggcgggcttcgccgcgctggattcggtcagcgccaccggctgcaaccccttcagccgcaaccgcgacggcatccacatcggcgaggccgcggcgctgttcctgatgagccgcgaacgcggcccggtgcggctggccggctggggagaaagcgccgacgcgcaccatatctcggcgcccgatcccagcggccgcggcgccgcggcggccatgcgccaggcgctggaacgcgccggcctcgcgccggccgacatcgactacatcaatctgcacggcaccgccacccagcagaacgacgcgatggaaagcctggcggtcagccagctgttcggcgccgccgtgccggccagttcgaccaagggcctgaccggccatacgctgggcgccgccggcgcgctggaagccgccttcgcctggctgaccctgcacggcaatccggcggcgcggctgccggtccatgtctgggacggcgcgcccgacgcggccctgccgcccctcaacctggtccgccccggccaggcggccgccacgccgccgcgccgcgcgctgagcaattctttcgcctttggcggcagcaatgcctgcctgatcctggaggccgcgcaatgagcgacgagctgtacgaaatcgactccctggtgccgcacgccggcgacatgtcgctgctggaccgcgtattgtccgccgacgccgacagcgtggtggccgaagtcacgccgcggctggaccagctgttttgccgcgacggcgaaatcggcagctgggtgggcatcgaatacatggcgcagaccataggcgtctgggccggtttgcgcgccaaagcccaaggccggccgcccaaggtgggcttcctgctgggcacccgccgctacaccgccgaggtatcgtccttcgcgcccgacgtgccgctgcaggtgagcgtgacccagcaattcatttccgacaacggcctgtgccagttcgactgtcatatcgacagccagggccggcgcctggccacggcccagctcaaggtgttcgagccggccgatatcgatcatttcatcaaggaatcctcgcaatgacagaccatgccattctggtcaccggctccagccggggcataggccgcgcgatcgccctgcgtctggcccgcgacggccatgacgtggtggtgcattgccgcagccgccgcgaagaagcggacgccgtcgccgccgaaatcgccgcgctgggccgccaggcccgcgtgctgcagttcgatgtgaccgaccgccaagccgccgccgccgcgctgctggccgacatcgaagcccacggctgctactacggcgtggtatgcaacgccggcctggcccgcgacaacaccttcgccgccatgccgccggaagactgggacctggtggtcaacaccgatctcggcagcttctacaacgtgctgcagccgctgaccatgccgctggtgcgccgccgcaagccgggccgcatcgtcacgctggcttcggtatccgcactgatgggcaaccgcggccaagtcaactacagcgccgccaaggccggcgtgatcggcgccaccaaggcgctggcggtggagctggccagccgcgccatcaccgtcaactgcgtcgcgcccggcctgatcgacaccgaaatggtggaagcgcacgtgctggatgaagcgatgaagatcatcccggcgcgccgcatgggcaagccggaggaagtggccgcgacggtgagcttcctgatgagcgaggacgccgcctacatcacgcgtcaggtgatttcggtaaacggggggatgatgggatgaagcgagtcgtgattaccggcgtgggcgccctcagcccgctgggccatgattggcaaagcgtgtacgcccggctgcaagccggccgcaacgtggtgcaggtgatggagccctggggcgagtacgaaggcctgggcacccaggtcggcgcgccggtgcagccgttcgagctgcccgcccactacaatcgcaaaaccacccgcagcatgggccgggtggcgctgatggccacccgcgccaccgaaatggcgctggaacaggccggcctgctgaacgacccgctgctgggcagcggccgcatgggcatttcctacggatcgtcgtccggctgcccggccaatatgggcgatttcggccgcatgctggtcagcaagaacatcgaaggcatcaacgccaacacctacatccgcatgatggcgcacaccgcgccggtgaacatcggcgtgttcttcggcatcaccggccgcgtcatcaccacctccagcgcctgcacctcgggcagccagggcataggctacgccttcgaggcaatccagagcggccgccaggtggcgatgatagccggcggcgccgaagagctggacccgacccaggcggcggtgttcgacaccctgttcgccaccagcgtcgcccacaacgaccagccctcgctgacgccgcgcccgttcgacgccgcccgcgacggcctggtgctgggcgaaggcgcctgcagcctggtgctggaggagctggagcacgccaaggcgcggggcgccaacatcctggccgaaatcctgtccttcggcaccaatagcgacggcaagcacgtcacccatccgcaatccgccaccatggccggcgccatccgcatggcgctggacggcgcccagctcgcgccgtcggacattccctacgtcaacgcgcacggcaccgccaccgatcagggggacgtggccgagtcgcacgccacccgcgacgtgttcggcgaaaaagtcgccatctcttcgctgaagagctatatgggccacacgctgggcgcttgcggcgcgctggaagcatggatgtcgatagaaatgatgcgcgagggctggttcgcgcccacgctcaacctcaccgaggtggacccgaactgcgcgcagctggactacatcgcaggcgacggacgccggctgcaaaccgagctggtgatgagcaacaacttcgccttcggcggcatcaacacctcgttgatcttccgccgctggcgcgactgaaccttcccgccggccccgcggccggcaccacccttgactactaggagcattagaagatgaaattcgccgccccgctgctggcgctggccctggtcgccggccccgccatggcccgcgacaccgtcgtgcagatcccgctggccgacgtgctgtccatgccggaagcgcaggaaaaactggatggttcggtcaagttctacctcgccggccagcatacccccgccatccagacaaaaatgggctccgatgtatccaaccagaagaccaacgcgctgaacaagtccgacgagcaagcctgccgctgggccattctgtccacgctgatctcgttccaggaatccgccaagaagcgccacgccaacgcggtggtcgacatcgtcagctattacaagaaggaagagcgccgcgataaagaaaccatcgaatgccactccggcacgatgatcgccggcgccgcgatcaagggcagctacgccaagatcggccgctgaggccatgccgccggccggcggcgcgaagccggcaaggccgcccggaacgggcggctgcttattgctccagctgccgcactcgctcgaacaggcaaacggtggccgccatcgccacgttcaaggactccgcgtgtcccggcatcgggatgcggatgcgggcatccgccagggccagcagctcgtcgctgacgcccgccccctcgttgccgaacacgaaagccaccgccccgctcagatcatggccgtacagcgagctggaaccctccagatgcgtgaccagcttgcgcccgccaaagccggccaattcggcggctaggtcggcgtgctcgtggatgcggagcgcgaagtgcgcgcccatcccggcgcgcagcaccttgggcgaaaacacgtccacgcagcccttggacaaaaacacctcgtaaacgcccgccgccgcggcggtgcgcagaatggtgcccagattgcccggatcctgaatatcctccagcagcactctggcggcggacgcctgcggcgcgggcggccgcggccgttcgcacagcgccagcaactcgccggcgctggccatggccgtcaccttggccatcaccgccgccggcagcgtcgccaccgcgcaaccagccggcagccgcgccaacaaagcctgaacctcgggatggccctgagcctcctcgttgacatacagccgcgtcagcgcgccgccagcttgcaggcaggattcagccaggtggatgccttccagcaccatcacgccctccttgcggcggtcgcggctgtgctgcgccagcctggccagcgccttgacttcgtcgttatggggtgaggtgatggtcttggagatgtaatgcatggtcgattcttgtggcggagcgaaggcgaaggggcagagtgtacccgtccccccgccttcttgcatcaatgctgcatctgcgtcagccgggtgaccagatccttgaagcggtggtaggtggcgtcgtctatcccgcggccgctgcgggcattgtcgacatagaacacgccgctgagcttgtggccgccgaacagcgtcatcaaggcgaattcgtgatcgccgacatgctggaaaaattcgtcctcgtaacgcctggtcagctgcgacctgacatcggccggcgcgtgaaagctttgcggcttgctggtgaacacgccgaagaagctgcccggctccagatccagcggcagcttgcgcagcgggctgtcgccggccacgcccacctgatagcgcagcttgaggttatggccgtcgtgctcgtaatggtagtacagcacccgctcgaacttcaggtcgttggccaggaagcggatggattcgcggatcgcgtgctccagctggtcttcgccggacagcgccgccgccttcttcatctcgcccttgcgcggccccggcggcagcagcagcaaggcccgcgccgggaaggtgtagccgatcacatgcgggtggcgcgccacgttcaacaccgcgtgaaccaccgccatataggccagctccggcatcacattgatcatcttggccgcagtgtccacgcccaccagccaggtgctgcgctccacgccctgctccagcgagttggcggtggcgatggccagcttcagcaactggcggcgcttggtcggcgcgcccgcgcctatcagcgccttgaagccgcccggcagcggcatgtgcttgacgaaagcctccagcacttggccgtagtcggcgtcgaaagcctccgacacttcctgcagcagcggcttgtccggcagctggttgcgctggatcatgtagatgcaggccggcaggttgtacagcagcgcggcgacgaaacagtcctcgaccttcaattcgcccatgatagacagccactccttgaccagcagcgccgccacgcggctgcggcccagccagtcccccaccgcctcgtagacctcagggtcgagcacgcctggagacggctccagcggaacgatcttgccgaagcggttgaccaccgcctccagccccatcagcatcagcgtctgctccaccgacgggatgctctcgttgcgctgcagcgcgcgcgaattgcccaccacccggaacaggtccagcagcaggaaagggtcggacaggcacagattggccagatcggtgaagttgatcaggtcgctgtggcgcgcgcaggcgtcggtcagctgattcagggtatcgggcaatatcggccagcgtttttcgccgatggacttggcccagtcattgagatccatttggatggcgccagatcaataattctttttgcaagggtccgccaagcggaatgcgctcgtcgggctgaatgtccggcacttcgaaagtattgctgatgagcaggctgcccggccgcccttcggacaggaacttgcgccataccttaggcatgggctcgggcgaaagaaacacgtagattgcgtcatagctcccccagtcttccttccagaaactgcggcaacccaccgccagccgcgccggccggccggcgcgcagccagcgcagccaggccagcagccagctgccgacggcgttttccagcgcgcgcagccgcagatcgggccgcagccgcgccagctgcagcgccagccggccgtcgccgcagcccgcctccagcaatgcggcatccgcagccaacaggctggccaatctgtcggccacccgccggccggaacggtaaagcggcacccgctcgaccagcgcgttgcgccccagcgccagcgtcagcagcagcgccagcagataccagccgggcggtatgccggcctggcgcatcgccaccgccgcggggacgaacaagccgtgggccagccgctgccagcccggctggcgcaaaacgatggccagcaaagccgccagcagcccctgcagcactgcccaggcggcgagatgctgcgccggcgcgatgaacacccaggcgccgacgcaggccaagagctgcaacagcaggtggcgcagccggctcatgtccgcgccggcgtcacggattgccggccggcgcggcgtcctggccgccgcctgggccgccgatcacttcctggttcatctgcggcttgaagccgtcgttgaggatggactgctcggcatccttgttcagcaccagaatggtgatgcggcggttttccggactgaacacatcgctcttgatcagcgggttggccgacgacagccccaccacccgcaaaatcttgctttcgctcaggccgccggcgatcagctcgcggcgggctgtgttggcgcggtcggccgacagttcccaattgctatagccgccctggccgccggcgaagggcttggcgtcggtatggccggagatgctgatgcggttgggcaactggttcaagtcgggcgccagctgctgcagcagcacgcgggtgtgcggcagcatgcgcgagctgccggaatcgaacatcggccggttctgctcgtcgacgatctggattttcaggccctccggcgtcatttccagcttcaactggctcttgtactggttcagcagctcgctgtgctcgatgttctgctggatcttctgctgcagctggtcaagcttggcctgctcctgctgcttctgcatgacgtcttccttgcgcgcgccggccttgttcacctggccggcctgcttggtcaggtcgttgccgccgcccttgaccaccgaggtggcgtcgccggcgccggcgccgccgctcagcgccaccttcagcggggtcttgaagtattcggagatgccgttcagcgtgcctgccgaggcagagcccagcagccacatcagcaggaagaatgccatcatcgccgtcacgaagtcggcataggcgatcttccaggcgccgccatgatggccgtggccgcctttcttgatgcgtttgacgataatggggcgttgcgattcgtcagccatggtgatctcccgtccgccttatttcttggcctgcttgacgtggtcttccagttccttgaacgaaggacggtccatcgacgacagcgccttgcggccgaactccaccgccacctgcggcgcgtagccgttcaggctggccagcagcgtcaccttgatggtctggtagacccgggtgccctcgcccagcttgtgctccagaatggtgcccagcgggccgacaaaaccataggccagcaaaataccaaggaaggtgcccaccagcgcgtgggcgatcagcatgcccagctccgacggcggcgcgcccaccgactccatggtgtgcaccacgcccatcaccgcggccacgataccgaaggccggcaggccgtccgccagacccttcaccgcgctgaccggcacttcgccctcatggtggtgggtctcgatttccacgtccatcaggttttcgatctcgaaggcgttgaggttgccgcccaccatcagccgcagatagtcgcaaatgaattcgaccacatggtggtcgtgcatcaccgacggatatttggagaacaccgggctggcttccggattttcgacgtcggcctcgatcgacatcaggccttccttgcgcaccttggtcaggatctcgaacagcagcgagaaaagatccatgtagaaggccttgccgtacgggctgcccttgaataccgtgggcagcgtcttcatggtggctttcagcggcgcgccgccgttggcgacgacaaaggcgccgatggcggcgcccgcgatcatcaccacttccaacggttgcatcagggccgcgacatgcccccctgctgcgatgaagccccctagcaccgagcctaggatgatgagatacccgattccgacgaacatgcgtcaagtcctgttttgatgttgccctatgccgttacttgtattacagcatgcctttttgcaattcattatagaaataatagaaaaagcgggtggaattgtaccaacccgcttcatcagctgtaaaacttgctgaggagacaaaattaccgcctccccagccagcatagccgcttacaccaagccgcgcgccttgatcgtctgctcgaactcctccaggcagcgcgacgccaccgccagcatctcgtccacctcggaccggctgatcaccagcggcggcgccgacacgatatggtcgccgcaggcgcgcatgatcaggttgttgcggaagaagatgtcgcggcacagcgtgccgacctcgccgaaatcggagaacagttcgcgcgtggccttgttcttcaccagcgtgaaggcctggatcaggccgacgccgcgcacgtcgtcgacatgctcgaagcggctgaaggtttcgcgccagcgctgctgcatgtaaggaccgatgtcgtccttgacgcgctggacgatgccttcgtcgcgcagcgccgtgacgttggcgtgcgccaccgccgcgcacaccgggtggcctgaataggtgaagccgtggttgaagtcgccgccctcgatcagcccctccgccacgcgctggccgatgaacaccgcgcctatcggcagatagccggaagacaggcccttggcggtggtgaagatgtcgggctgaaaacccagctgctgatggccgaaccactcgccggtgcggccgaagccgcagatcacttcgtccgccaccagcagcacgtcgtgcttgcggcagattcgctcgatctccggccagtaggtggccggcgggatgatgacgccgccggcgccttggatcggctcgccgacgaaggcggcgaccttgtcggcgccgatttccaggattttctcctccagccagcgcgccgccaccagaccgaattcgtccggcgtcatgtccttgccgtgcttgtaccaccacggctgctcgatgtgcgccatgccgggaatcggcaggtcgccctgctcgtgcatgtatttcatgccgcccaggctggcgccgccgatggtggagccatggtagccgttccagcggccgatcagcgtcttcttctgcggtttgcccttcacgtcccagtagcggcgcaccatgcgtatcatggtgtccaccgattcggagcctgagttggtgtagaacacgcgctcgaagccggcaggagtcacctccgccagcaggctggacagctccaccaccgccgggtgggtggtcttgaagaaggtattgtagaaaggcagctcttccatctggcggcgcgccgcctcggcaaaatcatggcggccatagccgacgttgacacaccacaggccggccatgccgtcgatgatcttgttgccgtccgaatcccacaggtacaccccctcgccgcgcgtcatcacgcgcgcgccctgctggttcagcgatgcggtatcggtaaacggatgcagatggtgggcggcatccagttcgcgccattggctggtggtacgttgcttctgcataacacttccttccagttttctccgacggagcgggccgctgcccgcccctcctgcgcctgcggcgtcgatttattcgaatgtcctgtctgtctcggcgattctacccgcgcgcgcgcttcgcgcactagacgtgcaacagcaggaacttgcgctcccacgggctgatcacgcggaaatactcggaaaactctttttccttcatcgccacgtacatcttgacgaagcgcggccccagcacttcggcgatctccttgcagccggccagtcgctgcagcgactcctccgaactattgggaaactggtaaggcagttcgtaggcgtcggtctggcgcggttcgctgggctgcagcttgttcaccatgcccaggtagccgcaggccagcgtggcggccatcgcgatgtagggattgacgtccacgcccggcacccggttttccacccggcgcgcggccggcgacgagtgcggcacgcgcaggccgacggttcggttgtcgtaaccccattcgacgttggtcggcgccgcggtgtagcgagacaaacgacggaatgagttcacatagggggcgaacagcggcatggtctgcggaatgtatttctgcaggccggcgatgaagccgaaaaagatctcagacggactgccgtcctcgttggtgaacacgttgcggccggtgttcttgtccaccaggctctggtggatgtgcatggcgctgcccggttcgttttccataggcttggccatgaaggtggcgtacatattgtggcggaacgccgcctcgcgcacggtgcgcttgaacaggaacacctggtcggccagctccagcggattgccgtgcaggaagttgatctccatctgcgcggtgccgatttcgtggatcagcgtgtccacttccaggttctgcgcgtggcagtagtcgtagatgtcctcgaacagaggatcgaactcgttgaccgcgtcgatggaataggagcggcggccgaattcggcccggccggtgcggcccaccggcgccgccagcggaatgtccgggtcgggattgggcgacagcaggtagaactccatctccggcgccagcaccggctccaggcccatgtcgtcgaacagccgcagcacgcgcttgagcacattgcgcggcgccacgtccaccggcgtgccgtcggcgcggcagcagtcgtagatcaactgcgccgtagggtccaccgcccacggcacgtagcgcagcgtgttcggatcgggctccagcaccatgtccgggtcggtcaggtccagcaggctgtcgtcgggatagtcgccggtgacggtctggatcagcaccgcctcgggcagccgcatttccgggtcggagacgaacttgtccttcggcacgatcttgccgcgcgccacgccggtcatgtccggcacgatgcactccacttcggtgatgcgatgctctcgcagccattcattgatctggtgattcataacgcttcctcagttgactccccggccgctggatacggctctggatcgggaggtgcttctttatgagtcatcaaaacgcgcgccgggttcaccggccggcgcgcggcactgccatcatccccgggcagccctcctcgcgcggcaggcgtcgccaaaggcgctgaagatcgcctgcgacaacggattttcccaatagcgccactccggatgccattgcaccgcgaaggcgaaagcccgcgcctcgcggatgcgataggcctccaccaggccgtcttcggcatgcgcttcggcgtccagccccggcgccagccgcttgatgccctgctggtgcagcgagttgacccgcgcctcgcgctggccggtccagcccgccagcaggccgccttcgacgaagctgacggcgtgcgagggcgcgtacatctcggcgacctcctcgctgtcggcctcgcgatggtcgttcaggccgggctgctcctgcacgtgctggtgcagttcgccgcccaacgccacgttgatctcctggaagccgcggcagatccccagcaacggcacgccctcctccagcagcagccggatcagcggcagcgtggtggcgtcgcgctgcggatcgtgcaacgtgccctgccggctggccggcccgccataatgatgcggctccacattggacggcgaacccggcagcaatacgccgtcgagcagcgccaccgtggcgcgcagcagcttctcgtcgcccagcgacggaatcagcagcggcaggccgcccgcgccgccggccgccgcggcgatgtatttgtcgcccaccgcgtgaaacggcagcttgcctatcattttcacgtcgctgggtatgccgatgatcgcttgctgcatggtgtgctgcgctcctctttcagctggcggccttgatggcctcgatggggtcgacataggcgtagcccagatccttcgccaccgcctggtgggtgacgcggccgcggcagatgttcaggccgttgcgcaagtgggcgttgtccaacagggcctggcgccagcccttgttggccagctccagcatgtacggcagcgtggcgttggtcagcgcctgggtggaagtgcgcgccacgccgcccggcatattggccacgcaataatggacgatgccgtcgacggtgtagatcgggtcctggtgggtggtcggccggctggtctcgaaacagccgccctgatctatcgccacatccaccagcaccgcgcccggcttcatggttttcagcatcgcgcgcgtcaccagcttgggcgccgccgcgccgggaatcagcaccgcgcctatcaccaggtcggcctcgcgtatgctttcgtcgatattggcgctgttggacatcagcgtcttgatgcggccgccgaacaccatgtctatctctttcagacgggtcagcgacttatccaggatggtgatgtctgcgccggcgcccatcgccatccgcgcggcgttcaggcccaccacgccgccgcctatcaccaccaccttggccggggccacgcccggcacgccgcccaacagcacgccgcggccgccctgcgccttctccagcgcgtgggcgccggcctggatcgccatgcggccggccacttccgacatcggcgccaacagcggcaggccgccgcgctcgtcggtgacggtttcataggcgacggcgatggcgtcggactcggccagcagcttggtctgctccggatccggcgccaggtgcagataggtgaacagcacctggccggggcgcagcagccggcactccaccggctgcggctccttcaccttgactatcatctcggcccgctcgaacacttcttccgcattggaggcgatggacgcccccgcctggatgtactgctcgtcggtaaagcctatggccaggccggcctgggtctgcaccagtaccttgtgtccgttcgccaccagctcgcggacgccggacggggtcaggcccacccggtactcgtggtttttgatctccttcggaacgccgatcagcatagtcgcctccatctggttctgttcatgggcaagcaaacaacatgcgtttaagaaaattcacattgcgcttgctccttccagctgattctgactataaaccctcatccttgcaaagataatcgattttgcgacgcagcaagcacaatgacgcttccacgcggtacaatgcctcaaatgtctaaaattattaacatattgatggagcaggaagaatggacgtcggcgcacggttgagaatggtcaggacacggttcggcttgtcgcaaagagagctggccaagcgcgcgggcgtcaccaacggcaccatctcgctgatcgagcagaaccgggtaagcccttcggtcagttccctcaagaaagtgctggaagggctgccgatcacgctggcagaattcttcactttcgacgccgagccgtcgcagccgcgggtgttctaccaggcggacgagctgcccaatctcggcaacgaggacatcaacctgatgctggtgggcaccagccacgacaagcgcgacatcgccatcctgcgcgaacgctacctgcccggcgccgataccggcccggacatgctggtgcacgatggccaggaaggcggcgtcatcatccgcggcagcatagaggtgacagtgggcaatgaaagccgcgtgctggggccgggcgacgcctattacttcgacagcaagttgccgcaccgcttccgcaacgtcggcgacgacatctgcgaaatggtgagcgccagctcgccgcccacattctgatgcgcagcaatcaacggagagctccatgaagctgggttacaccatcgtttacgtgccggatgtcgccgcctcgctgcgtttcttcgcccaggctttcggcttgaagcagaaatgcctgcacgaatccggcgcttacggcgagctcgacaccggagacactgtcctgtccttcgccagccacgaactggcggcgatgaatcttcccgccggccacgtgcgcgccagcgattcgacgcagccgctgggcatggaaatcggcctggtcaccgaacaggtggaggccgcgcaccggcgggcgctggaatgcggcgcgcaggaattggcagccccggcgcgcaagccgtgggggcagacggtgtcctacttgcgcagcccggacggcgcgctgatcgaactgtgcagtcccctttccgcctgaaatccgcaccgcaaccgcaaagcagcaccacacaagaggagaaaaccatgtcccgcagtacgcatgccgactggaaacaacttgctgcagaactgaaaatcgagggccgcgccttcatcgacggcgcctaccggcatgccgacgacgaacgccgcttcgattgcgtcaacccggccaccggcgccaagctggccgacatcgcccactgcggcgaagccgacgtcaacaaagcggtcaaggccgcgcgccgggcgttcgaatccggcgtctggtccggcctgccgccgatcaagcgcggcggcattctcaagcgcttcgccgcgctgatccgcgaacacgccgacgaactggcgctgctggaaacgctggacgccggcaaaccgatcggcgacaccaccagcgtcgacgtgccggccgccgcccattgcgtggaatggtatgccgaatcgatagacaagataggcggcgaagtggcgccggtcgatcccaagctcgttggcctggtgacgcgcgagccggtaggcgtggtggccgcggtggtgccgtggaacttccccattctgatggccagctggaaattcggcccggcgctggccgccggcaacgcggtcatcgtcaagccgtcggaaaagtcgccgctcaccgccatccgcgtggcggcgctggccaaggaggccggcattcccgacggcatcttccaggtattgcccggccccggcgaagtcggcaaggcgctggccctgcacatgggcgtcgattgcgtcgccttcaccggctccaccgcggtaggcaagctgatcgccggctacgccgcccagtccaacctgaagcgcgtatggctggaattgggcggcaagtcgcccaacatcatcttgtccgactgcccggatctcgcgcaggcggcccgcagcgcggccggcgccatcttctacaatatgggcgaagtctgcaccgccggttcgcgcgtgctggtccacagcgccatcaaggaacgcttcctcgccgaactgcaggccgccgccgcccgctactatccgggcgacccgctcgacccggccaccagcatgggagccatcgtcgacggcatccagcacaagaaagtactcggttatatcgacaaaggcgtgagcgaaggcgccagcctgctattgggcggcaaggccgcgcatgccgacaagggcctgttcatcgagccgaccgtgttcgactgcccgcgccccgatctcgccatctgccgcgaggaaatcttcgggccggtgctgtcggtgatcaccttcgacgatgtcgaggaagccatccgcatcgccaacgacaccgaatacggcctggccgccgccgtgtggaccgccaatgtcagcaccgcccatcaggtttcgcgccggctgcgcgccggcaccgtctgggtgaactgctatgacgaaggcggcgacatgaacttccccttcggcggctacaagcaatcgggcaacggccgcgacaagtccttgcacgctctggagaaatacaccgagctgaaaagcacgctgatcaagctgtaaaccctctgcgccggcctggcaccgcctgggccggcgcgtttcccctccgcctccccctccgccgcgcattctgaactcacccacccagcctgtctttgccctcttcgcccgcaaagccgccgcgcgccgcgcgccagccggagctagcagccgccgacagcccggctatgattgaaatcaaagacttccggatatttccccgcatgcagcgaatctaccgacttgccgtagtcggcctgctttggctcaccccccttgcccaggcagctgacagcagccccgcctgcccttccgggccgctcagagtgggattttacgagtatggcttggcttaccgcgccggacgcggctacgacgttgacctgatacgcgaattggcgcgccgcctgcattgccccatcgccagcgagagcgtgtttccctggatccgcaccctcaagatgctggaaatcggcgaagtggacatcgccacctccgccacccccactccggaccgtctgcaatacgcgtggatctacacctacaagcacagcaagagcatggtattgctgcgcaccgaggttcaagcccgcaccctggcggccctgccggacgaccccaagctgcgctggggcgtgatccgcggctggaagttcagcccgatgcaggaccagttgctggctgacctggccaaacgcaacaagatcgtgccggccgtcgatgaggacgatttgtacaagatgctggccgacggcgtgatcaccggcgcgctagcccacccgaccagctacgacgactggctcagaaacccgcgcatccgcaaccaggtggtcgtgctggatctgtttccggatgtcgaggcgaccgcgggcggcgtggcgctcagcaaaaagcgcttcccggaagcgtcggccgaactatggcatgcggagttgaaaaagatgtcccgcgacgggaccttgcgcgacatcttccgccgcttcctcagcgaggaaaccgcggactacctgctgcgttcgcccgttccctgacgcagcgtgccgcgcggcgcaacaaacgcgcgcgccgccaaggggtggaaacggcttccgcgccgacggaacatgagatgaatccacgagagggaggaaatacaccaaatgcggcgaaacatctgcctcgcgcttgccctgctcttcgccaccgtctgccaggccgcgcccaatccagcctgtcccaacgggccgctgcgagtcgggttttacaaattcggcgcggcttaccgcatgggccagggctacgacgtggacatggtgcgcgaactggcgcgccggctgcattgccagatcgcctcggagaccgagctgccgcggctgcgcgcgctgaaaatgctggccagcggccagatagacatcggcacctccaccctggccacgccggaccggctggcttacgcctggatctacccctacaaccacaccaagaacatggtgctgctgcacccctccctcaaggaacgcacgctgcccgacctgctgaacgatccggctctgcgctggggcatggtgcgcggctatcgccacagtccggagcaggaccaattcctggggcagctggacgcgcagcgccggctggtagtggccgacgacgaagacgatctgtaccggatgctgaacgacggaatcgtgaccgcggccttcgccctgccgggcagctatggccgctggctgcgcgacccgctgctcgccaagcgcatcgccgtgctggacctgttcccggccagcacgcccatcgccagcggcatggcgctgagcaaggtgcgtttcagccggcaagcggccgagcgctggcatcaggaactgctgaaaatggaccaggacggcagcctgctcggcatattgcggcgctacatcagcgacggcgccgccaagcaaatgatgcagttgccgctagactgaatgcagcggccccagcggccatcgattgcggagtgcgcagatgaaatggttggcagcctgcctattggcgctttgcctggcggccgcgcgggcggcgcccaacccggcctgcccgcaaggcgcgctcgccatcgcctattacgacttcggcatcgcctaccgccagggcaagggctacgaccccgaaatcatccatgagctggccaggcggctgaactgcccgatccagagcgaaaccgactaccccaggctgcgcgtgctcaagctgctggaaatcggccaggccgatatcggcacgtccacgctgatcaccccggagcgccagcgctatctatggctgctcccctaccaccacagcaagaacatggtgctgctgcaccgcggcgtgcaggccaactccctggccgagctgctgaagctgcccgacctgcgctggggcatggtgcgcggctaccggcacagtccggcgcagcagaaaatgctggacgagctgacgctgcagcacaaagtggtcgtcgcggagaacgaggacgacctgtacaaaatggtatgcaacggcgtcgtttccgcggccttcggccacaccgtcagctacgacccgtggctgcaaaaccatcaggcccagcagcaggtgacggtgcatgacttcttcccggacagcgagatcatcgccggcggcatcgcgctgagcaaggcccgcttcagccagggcgccgccgagctgtggagcgaggaagtgcgccgcatgctgcgcgacggctcgatgcgcgcgatcatgcgccgccacctgagccccgccgccgtcgagcaactgttcaaacagccgctggaatagccaacgccggatggccgcgaaaaagcccggcagcgcgccgggcttttcattcatccgagctgggcgggaatcacagcgccagcttggcgatggcttccttggccaggtggattgaggtggcgcgcttgtccgggcccatgccgatcgcttcggcgcggacgatttccacgtcggtcacacccaggaagcccagcaccttcaccaggaagtcttcctggaaatccatcaggctgccttgctcgccgctgtgcacgccgccgcggccggaaaccactaccactttcttgttcggcaccaggccgaccgggccgttttcggtgtacttgaaggtgcggccggccgcggctacgcggtcgatccagctcttcaactgcgtcgggatagagaagttgtacatcggcgcgccgatcaccagcacgtcggcggcgaagaattcttcaatcagctggtcggtcagcgccgcttcgctgcgctgcagctcggtccaatcagcttcggcggtgaagcgggcgccgacgatttcaccggacaggtgggcgatcgggttggccgccaggtcgcggtaggtggtttccaccttgtcatggcgctggcgcagggtgttggccaccacggcggacagttcgcgggtgacggaattgtcggccaggatgctggaatcgagatggagcagtttcatttggaggtctttccgtgtcgggtgggaatgagtgcatgataggcatgcgcaacaatccgcactagactgctaaaattggaaacattgttccaccaatgagacaatcccatgcatgatctgaacgacctcatgtacttcgccaaggtggtggagcatggcggcttcatggccgccggccgcgcgctgggcatccccaagtcgcggctgtcgcggcgggtggccgaactggaacagcggctgggcgcgcgcctgctgcagcgcaccacccgccggctggcgctgaccgagatcggcagccagtactatcagcactgccaggccatgctggccgaggccgaagccgcccatgaggccatcctgcaaagcagcgccgagccgcgcgggctgatacgggtaagctgcccggagttgctggccaaaaccatgctcagcgcggtgctgccgcgctttctggcgctgcatccgcaggtgcgggtggcgctggactccaccaaccgccgggtagacctgatagaagaaagcgtggatgtcgcgctgcgggtgcgcaacgtgatagacgacagcgccagcctagtggtgcgccggctgggcaagagccgcttcatcctggtggccagcccggacttcatccgccagcatggcgagccgcaggccccggagcggctggcggcgctgccggcgctgagcatgagccggcccgacggccgcggccaatggacgctgctggacaacatcggccagagctacaccatccacctggatacgccccggctgatgaccgacgacatgatagtcctgctggaggccgccatcgccggcgtcggcgtcgccgcgctgccggccaacgtctgccaccaggcgctggcggacggcagactcaggcacatcctgccgcaatacgactttccctggggcatcctgcacgccgcctttcccacccgccgcggcctgtcgccggcggtgcgcgcctttctcgacttcatcgcccaggagctgatcagcgacgagatggcgggcgactgggggcgcagcgacattcgcccggcatgactattgctttggcagaatggtgttcattccattccgctccgccatgttcaccatccgtccactgaccgaaaccgactccatcgacgccctcaccgccctgctgcaccgcgcctacgcgcagttgggcgcgatgggactgtcctataccgcggtgagccagagcgccgaggtgacccgccgccgcatcgccggcggccactgcctgctggcctggcaccgcgacgagctgataggcaccgtcacggtgcatcatccgctgccggcttcgtcctgcccgcagtttcgccagccggatggcgcggtgctggtgcagctggcggtggcgccggactgccaaggactgggcctgggcgagcggctgatcgccgccgccgaagcctgggcgcaagcgcagggctatcgcgccatccggctggataccgccgtggaagcccaccacctggtcagccgttatctcaggcgcggctaccgcatggaagcgccgttgcaatggccggacaagccctaccgcagcgtggtgatggaaaaacgcctggaaccgatggccggcgcggacactcctaaccgctattgcactgcaacagaatgatggccgcgcgccacaagtgtccgcccccgccatccgcttttattgcattgcagcaacaagcgagtacagtggcgtccatggctcagtcatgggccgccgcgtccgtctccatcttttccaaagcaaggggttgcaatgtggtcagctactgcagttcaaggcgggacactcccgttcgcacaaccgctgtttgattactggctcgatgcctgccagcgcggcgtcctgtactgggacacgctgtaccggcgcggcgccacctatctggagcattgcgaaagcggcaagccgccggtgctggtgttcgattaccgcatcatcctggacgggcgcgaattgcccgacccggccaattacgcgctggccgccatcgagccgccgcccagctgtccgcccaccgaccccgccaagcgccccttcgtcgtgatagacccgcgcgccggccatggcccgggcataggcggcttcaagatggacagcgaaatcggcatagccctgcaacagggccacccctgctacttcgtgatgttcttcccgcagccggtgcccggccagaccatagaaagcgtcagcaaggccgaaggcgtcttcctcaagcgcgtcaacgagctgcaccccgatagcgacggcaagcccttcgtcatcggcaactgccagggcggctgggcgctggccatgctggcgtcggtggcgccggacctggtcggccccatcctgctggccggatcgcccttatcctactgggccggcgtgcgcggcaagaacccgatgcgctacgccggcgggctgaacggcggcacctggaccgcatcgctggccggcgacctcggcaacggccgcttcgacggcgcgcatctggtcagcaacttcgagaagctggacccagccaataccttatggaagaagtcctacaacctctattccaaagtggacaccgaaccgcagcgctacctggatttcgagcgctggtggggcggccattacctgctgaacaaggcggaaatggaatggatcacccagaagctgttcgtcggcaacgatctggtgcacggcaaaatcgccagccatgacggcaagctgcgggtggacatgcgcaacatccgctctcccatcgtggtgttcgcctcctggggcgacaacatcacgccgccgcagcaggcgctgaactgggtggccgacctctacgacaacgtggaagacatccgcaacaacgaacagacaatcgtctactgcctgcacaacaaggtgggccacctcggcatcttcgtctccgccggcgtcgccaacaaggagcacagcgaattcgccagcgcgctggacctgatagacgtgctggcgccgggcctgtacgaagccgtcatcgaagacatcgcgcccgacgcgccgggacaggaatacatcgaaggccgctacatcatccgcttcgaagcgcgcgacgtatccgacatcctggcgctggacgacggccgcgacgacgagcacgccttcgaagtggtgaagcgggtatcggaaatcaaccagggcctgtatgaccgcttcgcctcgccgctgctgcgcgccgccggcaacgaagccggcgcccgcctgctgcgcgagttgcaccccgcccgcctggaacgcacgctgatctcgccgaaaaacccctggctgtggtggctgcccggcctcgccgcccaggtgcgcgaacagcgccgcccggcgcccctggacaatccgctgtggcaatggcaggaacagctgtccggcttcatcggccaatcgctggatcattaccgcgacctgcgcgacgccgcccaggaacagctgttccgcgccatctacgaatcgccgcagctggcgacgctggtcggcgtgcagccggcaagcgagccgcgccggcatgcgcttgcctgggaaagccgcgaactggcgcgcctgaagcgcgaggcgctggcccccagcttcgagcaaggcacgctggccgacggctttgtgcggctgttgctctatgtcagcatcggcatgggcgtggtggatgagcggccgttcaacgccatccgccgcgtgatgcgcgacgtcaggcacgaatacccgctgacgctgatgcagttgaaggacatcgtccgccaccaggtggcgctggtgcggctggacgcgccgcgcgcgctgaacggcctggcggcgctgctgcccgacgcgcatcgccgccgccaagcctggacgctggcgcgcgacctgctgacactcaacggcccgatcccggccgagcaccaggcgcggctggacgaagtggccaggacgctgcaattggacatgcccgccgcccctggccatccgactgcgccgtccattctgccccaactggaaacggcagccgcgccggcggaaatcaaggccgagaaagccagcgcctccgcgttgcagcccaaaccggcgcccgcgcgcaaacccgcggcaaaacccgccgcggaagccgccccggccgccaaacccgcccaggccgaggcaaaacccgccgccgcgcgcgcgcgcaaatctcccgccaaagccaacggccaagcccccgccgccgcgccggccaaaaccgccaagacagccacgccggccaagcgcccaggcaaggcctgatccggcaaccggggcgcgaaagcgccccggttctgacattgactattccaatagcaaaagctaatattgcgtctctctgcgggagagaggggccatgcccccgccgaagacgcaagctcccataatcgctcaggcaagccgtaccgcagtgtttcattgattcaagccgattggagagaggctgccccgagcagcccaccgaaggggcaagtggccgcaagccacgcaactctcaggtaaaaggacaaggggagaggctgttccgtagcccggaatccacccaggagtctgccttgtcccgctctcagtccagcggcgcccccggcgtttgccgatggcccgcccgcacgtcatcccccattcctccgttgccggctcgtccggcgttattgccgcaacctcgcaagacaccatcatgctgaccctgatctacctgatcgccatcaccgccgaggcgatgaccggcgcgctggcggccggccgccgccacatggacatttttggcgtaagcgtcatcgccttcctcaccgccctgggcggcggcaccgtgcgcgacatcgtgctgggccgctacccgataggctggacccagcacccggaatacgtgttgctggtggtggccggcggcatcgccgcggtgctggccgcgcgcttcatgcgccatctgaaccgcctgttcctggtgctggacgcgctgggcctggtggccttcaccatcatcggctgcgatgtggcgctgggcatgcactaccatccggtgatagtggcgatggccggcatgatcaccggcatcgccggcggcatcctgcgcgacgtgctgtgcaaccgcgtgcccatcgtgtttcgccgcgagctgtacgccagcgtgtcgctgctggtggccatgctctacatgggcctcaaccagctgaacctgccgcacgactataatatcgccgccagcttcgccttcggcctggccttgcgcctgaccgcgctgtggcgcgaatggcagctgccggtattcgcctaccggcacgatcaccactaagccgccgacgccccgctgccgcggggcgtttcgcttgatcggcgcgcctcatgcttgaagccaccccgccgggatgccatgatcagcccctttgctgactcgccggcccagaccccgcctcccacatgcgtccacccccactccgcccaaccatgcccctccgccgcctcgccatccgcgcgctggccggactattggccctgcccgccgcataccttctggcagccctgctggccggcctgctgccagtcaacaagggctggcaagcgccggcagacggcatcgccgtgtatctgcaggacagcaatggcgtgcataccagcctggcgctgccggtacagacgccgcaacaagactggaacgcgctattctctccgcgccaaactcagcggcccgagctgtccgccgcgcagccgtacctcgccatcggctggggcagccgcacctttttcctgcgcacccgcagctgggccgacctgactgccggcaatgccatcgccgcgctggcctcggacgccagcgtgctgcacgtcgaatatctgcccaagccggcagaggacgccgatacccggaaaatcctgctcacgcccggccagtacgcgaaactggcggcattcatccggcaaagcgccgcggccggcgccgatggcaaaccgctttggctgacgaatgagcgctatgatggcaacgatgccttctatcaggcccatggccgctacaccccgttcgtcacctgcaaccagtggacccgcaacgcgctggccgccgccggcgtgcgcactgccttatggtcgccgttcacccggcccttgttctggcgccttcatggctgagccaatcccatccgcacaggaaaaatggcaaccacctgtccttttgttcaggtgaaaccgccattctcctaccctcggttgcaacacaagctccccaccctttaaaatgccggcttccgcttaatagccaatccataccctcttccgagggtatttttgcgtttgtcatcgccatgaaccttagcgccctcctcgccagcttcgcctccgccttcacccaggaccgccgccagctcaccctgcaactgggcgacggccatgtcgcggccgagcagctgctgccgcaaagcctggacggcgaggaaggcgtgtcccggccctatcgcttcaccctgacctgcctgtcgcccgacggcgccatcgaactcaagaccctgctcggccaatccgcccgcctcggcatcgccgacgccgccggcggcgaaacgatacgctgcggcgtggtgtcccaggcccggcagctgggcgccgacggcggcttcgcccgctacgcgctgaccatcgagccgccgttcgcgctgctgcgccaccgccgcacctcgcgcgtgttccaggacctgacggtgcccgacatcgtccagcagatcctgcaagagcaccaggccgccaacccggccttcgcccgcggccaggcgatcgagatcaaggtcggcccggcgcagcccagaagctactgcctgcaataccgcgaaagcgactacgacttcatcgtccgcctgctgcacgaggaaggctacgcctggcgcttcgagcatgtcgacggcgacgcgccccaggtcaagctggtggtgttcgacgacgcctacagcctgccgccggccgaagtggaacgggtgcgcttccaccgcagcgacgccaccgaagacgaggacggcctcaccgcctggcacgccagccgccagatcgtccccggcagcgtcgcgctggccagcttcgactaccagccggtgtccacccagcacagcggcgacagcagccagatcgaccagggccagggcggccaggcgctgcaatccagcctgcaggactacgacccgcagggcctgtactacgccggcgacgccgaccagctgagccactacgcccggctgcgccagcaggcgcacgacctgcaggccaaacaattcgaaggcggcggcgccgtccgcggcctcaccgccggccaatggttccgcctggacgaccacccggcgcacgagaccgacagccacgaacagcgcgaattcgtcgtcaccggccagacgctgcaagcgcgcaacaacctgcccagcgagctgacccagcaactgcgcgccctcgcccccagcctgctggccgacagcgacagccaggccgcccccttcgccagccagatccaggcccagcgccgcggcatcccgctgaccccggcctacgccggcaccgccgcggccaagcccaccagcctcggcgtgcagaccgccaccgtggtcggccccgccggcgaagaagtccacaccgacgcccagggccgcatcaaggtgcaattccactggcagcggccggacgaacaatggtcgggtgttcgtccggccgctgccagtggaattgcaccttgatgcggccctgggcgtcggtgtggacttcttcgccggcggggccgaccacggtggcggtctgcacgccgaggctggtgggcttggccgattcggtgccggcgtaggccggcgtcagcgggatgccgcggcgctgcgcctggatctggctggcgaagggggcggcctggctgtcgctgtcggccagcaggctgggggcgagggcgcgcagttgctgggtcagctcgctgggcaggttgttgcgcgcttgcagcgtctggccggtgacgacncttcctcggcttcggcgtcgacgtgcgccaggtcagctggggatcgatgctggaagaagcgccgaccgaactgatccagggctattggtggcagatgctggcggtgaccgtggccatgtcggtgctggtgacagcgttcagcctgctggtggatgcgctgcgcgacgcgctggatccgcgcgcggtggccaagtaggaggcggcaagtggagaaccatcaaatgaatcagcaaaacaccctgctgtccgtgcgcaatctgaaggtgggtttccgccaggaagacggcggccgcttcgaggcgctcaagggcgtcagcttcgacattccggcccaccgcacggtggcgctggtcggcgaatcgggctccggcaagtcggtgacgtcgatggccatcatgcagctgctgccgccgcaatccagcgagatcgatccggcgtccgaactgctgttccagggccgcaacctgctgcggctgtcgcgcggcgagctgcgcaagctgcgcggcaaggacatcgcgatgattttccaggagccgatgagctccttgaacccggtgttcagcgtcggcgagcagatcgtcgagacgctgacccttcacgccggcttgagccgttccgccgcctggaagcgcgcggtggagctgctgcgcgaagtgggcctgccggagccggaaaagcgggtgaaagcctacccgcacgaactgtccggcggccagcagcagcgggtgatgatcgccatcgccatcgcctgcgaaccgaagctgctgatcgccgacgagccgaccaccgcgctcgacgtcacgattcagaagcagatcctgcaactgatcgccgacctgcagaagaagcacggcatgtcggtgctgttcatcacccacgacctgggggtggtcggcgaattcgccgacgaagtgatcgtgatgcgccacggcgtgatccgcgagcaaggcacggtgaagcagatcttcgaaaacccgcaggacgcctacaccaaggcgctgctgtcgtgccggccgcacctggaccgccgcccggagcggctggcggtgatcgacgacttcctccagccgggcggctatgtcgaaccggccgaaaggacacgtggctacgccgccggcgacgaaatcgtgctggacgtgcaagggctgtgcaagagcttcgacatccgcgaagggctgttcggcaagcgccagttccacgcggtgaaggacgtgtcgttccagttggcgcgcggcaagacgctgggcatcgtcggcgaatccggctcgggcaagaccaccgttggcctgacgctggtgcggctgcaccaggccaccggcggcaaggccttgttccacggccaggacctgatcggcatgagcgccaaggcgttccacgcctacaagaagcggatccagatcatcttccagaacccgtacgcgtcgctgaacccgcgcttcaccgtcgagcagatcctgaccgagccgatgctgctgcacggcatcggccaggacggcgggcagcgccgcaagctggcgctggacctgctggacaaggtggggctgccggcgggcgcgctggccaagtacccgcacgagttctccggcggccagcggcagcggatcgcgatcgcgcgctgcctgaccttgaagccggaagtgctgatctgcgacgaatcggtatcggcgctggatgtgtcggtgcaggcgcaggtgctgaacctgctgcaggacctgcaggacgagtacaagctgtcctacctgttcatttcgcacgatctggcggtggtgaagcacatctcggaccaggtgctggtgatgaacaagggtcaggtggtggagcaggcggatgcggacgtgatctaccgcgagccgaaggacagctacaccaagaagctgctgggggcgatcccgcaggggtggaacgcggcgctggcgccggcctgagttctggtgaagtcgaaacgaaaccggccgcgaaggccggttttttatgtctatggtttcgcgttccgctcgccggcgtcagccgtcggcgaaatccaggctgacggtccaggccgtttgctggctcacgctgtaggagatcttggcctggccgtcgctttccgtgacgcctagcaggccgctgccctcgttctggcccagcgtcagctggtagaagccatcgccgccgtagtcgtagtcggggccatcggcgaagatcacgcccagcatgtaggcgttgccggggccgctccagtccacgctcaactggaccgactgatccggccccagcggataggcgccgctctcggcctggccgtctatcagcagtgtctggtcatcccagttgggatcgccttcgatgaagacgtctcggctggaatggtttttcacggtgactacgggttggctcatctgcatctccttgcgggcgtgtgtgggaagggcgccaggcaaggataggcggcggagccggcaagcttgccgacggctgtcctttcagccgggcgagatgggcgcggacaatcaaccgaatcaatttgaaggacgacgatggggtggggacgtttgctggccgcgatcgcggtttgcaatctggcgtattggctggctttgctgctggcggccaggttttatggcatacgggtgcgggagcattgcgtgggcatcgggccggtgttgttcggcaatggcaagctgcagctgcgcttgctgccgatttccgcctgggtgcggatggcgctgctggctgaccgccggccggaggaggcggaacgcgtttgcctggatgccaaggccgttcccattcagctgatcgtcgccgcttccggctgcgtggcgctgctctggctgggggcttgcctgaatgagggcgcgagcctggatagttttcgcgcaggctggtcgcaactgccgttcggcgcgctgccgccatggggcgaggcgcagcattggctggccgcgctgtcggactggacggcgcagtcgggcttcctggcgatgttgccggtggtcgcggccaagatggcggtattcaatttattgcctttgccgggagcggctggcgggatcatgctgcgccttttggtcccgatgggggcgcggccggcattcgaacattccaacgtgttccggctatggatggctgcgcacctgctgtggctgttttgctggctggcggcgctggcgcttcatgtctggccatttggctgagcgtcgtcggccggccgcgccagttgttccagcagccacccggccgccgcgcccagcggcctgttggcggcccacaccaggtctaccggcatccgcttgggccagccggccacgtccagctgtttcagctcgccgccgccaaagcttttcaccagccagcacggcagttcagcccagcccacgcccaggcgcgccatgtccagcagcatcaggtagctgggcgcgtaccattgccgctggccggcgtgggcggggttcttgtcgttgtaggtattcagccgcaactggcgatgcagggccagttgctgttcgtcgatgcggtccattcccgccagcggatgccggtatgctgcgtacagcgccagctcgctggcctcgcgctggcgctgatggcggatatccggcggatagcggtccagcgcgccgaccaggcccagttgcgcgcgcccggacaagatcagatccagcacgtcttcctgttccccggccaggcattccagctccagcagcgggtagcgcgcctccagccgacaagcgacgttttccagcgtttcggactggaaggtgtcggacagcacgatggtgagccggctttccacgcccgcgctcagcagcgccgcctgttgctgcatgtcctggctggcattcatgacttggcgcgcctgcggcagcagcagccgtccggccggggtgagggtgggcgtgcgggtgccgcggtcgaacagcaggttgcccaggtcgatttccagattggcgatggcttcgctgacggtggactggcttttgcccagccgcctggcggcggccgagaaggagccgagctcggcggcgtagacaaaggcggagagggcgtcgacggagagagtcatatcggtttaaccgatgagtggtatttttatagtatccggaaagccaatcataatgccaagcattgaacttcagcagtcgggagaaatcgatgcaagcggcaaacaagaaactgggcgagcgagtactgcatgcggtgctgtacgaggcttgcgcgatggcgttgctggtgcctttggcggcgctggttatgcaaaaggacgtgctgcacatgggcgcgctggccttgatgatgtcgacggcggccatgttgtggaacatggtgttcaacgcgctgttcgagcgcgtggagcgtctttttgggtggcggcggaccgccggcgtgcgttgcctgcacgcgctgggtttcgagggcggactggtgatattgctggtgccgctggccgcctggtggctggatagcggctactggcaggctttcctgctggatttgggcttctttgtgtttttcctgccttacacctatgtgttcaactggctgtacgaccatctgcgggagcgctttgtcgctcggcggggcttgtcggccgcagtggagtgatcgatgaaagtctggctgttcctgatgggggccatcctgtccgaagtggtggccacttccgcgctgaaggcgtcggatggctttacccggctgtggccgtcgctgttgaccgccggcggttatctgctggctttttacctgttgtcgcagaccttgcgcgaaatcccggtgggcatcgcctacgccttgtggtccggcatcggcatcgtgctggtttcgctgatcgcctggctgctgtatggccagaagctggacgcggccgcgctggccggtatggcgctgatcatcgccggcgtggcggtgatcaatctgttttcccagtcgtccgcgcactgagcgccgcggtgcgcaagacgtttttccagggccgccctccagggcggcctttgtcatgtgattttatacaacacttttttatgctttatgattattcatattgggtgttttgtgtctttttgtggttaaaaagtggcatttccatccggcattcatgccggattgttttttcaagatgccgctttgctatcaatggcttgcgcggccaaggggatggcagttcgtcatgccggcgcgccgaatatcagcgatttgccgaatagattgcgttattgtttgtttgaattaaactgatttcaattatatttacatatcaaatatagattcttataatcaacggtttactttagattgttcggattgattctcacgccccagcggcgcaaaactttgccgccgcgatcaaccggacccgcaatctcatccatactgtatgcatcaagacacctcgcgtttacgttttcatctgcagagtcaggattttcattatcaggaactcggccgggatgccgaggtggtcgagatctgcgagcgctggcctttactgcaggccatctactgcggtcagaccgatagccgggagcgggaggacgccgcggcgcctgcgcgcgaagcggcgagcgatacggcttgatggagcacgacatggcgattttggcggtatgcggagtgaagggcggctgcggcgccaccacggttgcggcggccctggccctgttgtggcagcggcagcaaaggccggtgctggcgatggacttgtgccggcaaaacctgctgcgtctgcatttcggcatggagtggcatgaggccgatggctggcggcggcggcgcgacgccggcgccgactgggcccgcgcggcgtgggaagtgggcgaccgccacctgacgctggtgccgcatggccgggtggaagaggatgtcgaccaggaagggccggaaccggaagaatggctgcgcgacgagctggcgcagctggagcggcagcccggtcaacgcacggtgctggacctgccggcgcgcggcgtggccgagcggcagcagggcctgaaagcggccagccacgcgctggtgatgctgtctgccgaccccgccgcctgcgcgttgctggatgcggtggaggcagagcttcacgccggtggcttgccggctgagcgcatctttttcgtcatcaatcatttcaatccgctgcgcaagctggacggcgacgtcgagctgctgctgcgcaagaagctggggcccaggctggcgccgctgcccatccaccgcgacgaagcggtgcgcgaggctttcgccaagcagcagccgctgttcgattacgcgccggccagccaggccgccgatgatttgcgccagctggcggtatggctgtcggttaggctggacgcggggcggagcggcgcatgagcttgcggggggcggattggcgcgcgtggtgcctgcggctgggtttgctgcatccggccgacgcgccgcggctggcgtttgcgctgctggggctgttcttcgtcgcgccgacagaaggctgggcggcctggggcagggcggcgcgccgctatttcccgcaggtggatttttcccggctgcggccggccgatccgctgcgcatactgctgcagctgctttggctggcgctggtcaagccgccgcgcgcgctggggcccaggcgccaggcgcgtttgccggcgctgctgcagttcgcgcgccgcgagctggcggctgtttccgcccagcgccgccgcctcgccggctggctggagggccgctttccgcgcttgttcgatccggccagcctgcgcggctcggtggagggcatagccgaacacgcctggtggcaaagcgcggcgatccgaacgatttgctacctggcggcggcattgctgggcgtggtgctggtgacgacgccgttcgacgaatactcccaagcagtgttcaccgtggtgctgttgctgatggcgctgtgggtgcggcgcatccccggcccggtgccgacgctgattctgatggtgttctccatcgcggtgtccacccgttacatttggtggcgcaccacctccaccatcaatgacgacacctggccgaatctgatcgccggcgtgatcctgctgggcgcggaaatgtatgcctggctggtgctgctgctgggcttcttccagtcgtcgtggatgctggagcgcaaagtggtgccgctgccggccgatacttcgctgtggcccagcgtcgacgtgttcatccccatctacagcgagccgctgcgcgtgctcaagcccaccgtgttcgcggcgatgagcatggactggccggccgacaagctgcgggtgcacatcctggacgacggcacccgcgacgaaatccgcgatttcgccgcgcaaatcggcgtcggctacatcgtccgccaggagcacaagcacgccaaggccggcaacatcaatcacgcgcttggccgcaccgacggcagcttcgtcgccatcttcgactgcgaccacatccccacccgttccttcctgcagacgacgatgggcggctttctgcgcgatgagaagctggcgctggtgcagacgccgcaccacttcttctccgccgatccgttcgagcgcaatctgaacacccgcgacaaggtgcccaacgagggcgagctgttctatggccgggtgcaggacggcaacgacttgtggaatgcctccttcttctgcggttcgtgcgcggtgctgcgccgcgacgcgctgatgtcggtgggcggcatcgcggtggaaaccgttaccgaggacgcgcacacctcgctgaagatgcaccgccgcggttaccactccgcctacatcaacctggtgcaggctgcgggcctggccaccgaaagcctgtccgcccacgtcggccagcgcatccgctgggcgcgcggcatggcgcagatcttccgcagcgacaatccgctgctgggcaaggggctgacgctggggcagcgcttctgctacctcaacgcgatgatgcacttcctgtacggcatcccgcgcctggttttcctcaccgcgccgctggccttcctgctgttccacgcctacaccatctacgcgccggcgctgggcctggtgctgtacgtggtgccgcacatggtgttttcggtgatgtccaactcgcggatgcacggcgaattccgccgctccttctggggcgaggtgtacgagacggtgctggcctggtacatcacgctgcccaccacggtggcgctgctgtttcccggcctgggcaagttcaacgtcaccgccaagggcggcgtggtggaggaagaccatgtcgattggaacatcaccaaaccctatctgttcctgctggcgctgaacctgctgggcgtcggtttcggcgtctaccgaatctggagcgggccgggcaacgagatcggcaccgtgctggtgaacctgttctgggtcggctacaacacgctgctgctgggcgtggcgctgggcgtggcgcgggaattgcgccaggtgcgggtgtcgcaccgggtggaaagccgcctgccggtatcgctgcacctgcacgacggcaaggtctatccctgccatacgctggattactccgaaggcggtatggccttgcagttgcccgagggcctgcaactgaaactgcggcagaacaccgagctgacggtgtcgatgcgccgcagcggccgcagcttcgcgctgccttgccgcctggtgttttccaagggcggcaggctgagcgtgcgtttcgtcggcctgacgctggacgaggaaatggcgctggtgcaatgcacgttcggccgcgccgacgcctggctgcaaaccggcgagcgcgcgcacgagggcacgccgctgggcggcgcctgggacatctggcggatgggcggcggcagcttgtggcagctggcgcagcagttgttttcgccgctcgcggtccgcaatggccgctgggccggcttctggaattggctgggcagcctgctgccgcggcagccgcatcttcatcgggacatcaaatgacaagccgcataccaagaaaaaccctgtccattctgctgtccggcctgctgctggcggcgccggcgctgagtgtcggcgccaaggaggagacggcggccgcgcagccgccggcccaggcggcgccgctggtcaccacccgcaccctcagcttcaagcagatgggcgccggctatccgctcaagatgcgcggcgacaacagcctggtcggcgtcggcttcggcagccgcggcgacgaggtgatcaccgggctgacgctgcatctgcgttacaccttctcgccggcgatgctggccgacctgtcgcacgtgcaggtgctgctcaacgacgaagtggtgaccgtgctggccttgcccaaagagcagggcggcaagccgcagcagctgaccctgccgctagacccgcgcctgctggccaatttcaaccagctcaagttccgcctgatcggccattacaccaatcgttgcgaagacgaaacccacagcagcctgtgggcggagatcagcaatgccagcgaactgcagatgacggtgcaggcgctgcctttcgtcaatgatctgagctatttcccggagccgttcttcgaccggcgcgatttctcgccgctgaagctgcccttcattttcgccgcgcggccgtcgcaaacttcgctgcaggcggcgggcgaactggcctcgtggtttggcgcccaggccggctggcgcggcgtgcgctacagcgccgcgctcaacagcttgccggcggcgcagcacgccatcgtttacgccgtcaacggccagcgtcccgacttcctcgccaagctgccgccggtgaacgcgcccaccatcgccatcgtgccgcatccggaacgccccgagcgcaagctgctgctgatcctgggccgcgacgacaaggacctcaagctggccaccgacgcgctggtgctgggccaggctggcatgagcggcagccaggtggcggtgcgcggcatcaagctggaagcgccgcgcaagccctacgacgcgcccaactgggtgcgacccgaccggccgacccggctgggcgagctggtggacaatccgcgcgacctgcaggtcaccggccagcagccggcgccggtgcgcgtctcgttccgcgtgccgggcgacctattcacctggggcagccgcggcattccgctggacctgaaattccgctacaccggccagcagcaggcgaccggctcgcgcctcaatatcggcatcaacgagctgttcgtgcaaagcctgaacctcaacgccagcggcgtgggcagcacccagaccagcctgcgcctgccggtgctggaaaacggcttgctcagcaatatcgaccgcatcctgctgccgcctttccgcgtcggcagccgcaacgagatgcagttccagtacgtgttcgccgcggagaagcagggcgagtgcgccaataacctggccgacggcaaccgcgcggcgatagacccggactccaccatcgatttcagcggctatccgcactacgcggcgctgcccaacctgggcttgttcgccacttccggcttcccgttcacccggatggccgacttgtcggacaccgcggtggtgctgccgcgccagccggcgcagcaggacatcggcgccttcctcaatgtgatgggccagatgggccagtccaccggttacccggcgctgcgctatcggctggtggacgagggcgcgctggatagcgtcaaaaaaatggacctgctgatcgtgggcaacgcccgcaacctgggcttgctcaaagcctggcgcgacaagctgcccaccacgctggacagcgccggccgcaaggtggctgagggcgaaaccaccgatctgccggccggcatgggccaagcgccgggccaggcggccggcggccgcatcaacggccaggtggacttcgccgcccagggcaagctgggcgcgatcctggcgctggaatcgccgctggccagcggccgcagcgcggtgatcgtcaccggcagcgagcccgacgcgctggcgctggcgaccggcgcgctggccgacgacggcaaggtggcgcagatgtcgggcagcgcggtgctggtgcgcggcgacaccatagacagccagcaactggggccggtgtactatgtcggcaacctgccgctgtggacttgggtgtggctgttcctgtccgcccatccgctgctgctggcagggctgtcggcgctggcggtgctgatcttcgccttcgccatcctgcgcctgttcaaggcgctggcggcgcgccgcatccgggagtcttgaggtgggcatcccgcgacgcgcgctgctggcggcgctgggcgcgctggccatttccacggcccgggccgcgccgtgcgacggctggccggcctggcaggatttccagcgccatttcgtttccgacggcggccgggtggtggaccgcggcgccgacggccagcccaccacttccgaagggcaaagctacgcgctgttcttcgcgctggccgccaacgaccggccggctttcgacaagctgctgcgctggacccgcgacaacctggccggcggcgacttcagcgcgcgcctgcccgcctggcaatggggcaagcgcccagacggccagtggggcgtgatggacgacaacagcgcgtccgattccgacctgtggatagcctacaacctgctggaagccggccggctgtggcgcgagccgcgctacaccgcgctgggcaagctgctggccttgcgcatcctgcgcgaggaggtggccgacctgccgggcctggggccgaccctgctgcccggccgctacggcttcagcaagccggggctgacccggctgaatcccagctatgtgccgccgcaactggtggcgcgcatggcgcacgccttgcctggctccggctgggcggcattgcgcggcacctcgcagcgcctgctgctggagagcgcgcctgcaggatacgcgcccgactgggcggcttaccgccagggcttttccgccgatgcggccagccaggccgccggcagctacaacgccatccgcgtctacctgtggaccggcatgctggcgcccgacgcgccgggccggacggccttgctggccaaattcaagccgatggcgcaactggtggccaaaaccgggctgccgccggaaacagtggacacccgcaacggcaaggcacagggcaccgggccgatagggttttcgatggcgctgctgccgttcctgcaagcgcaggacgagcaggcggcgctgcaggcgcagttgctgcgtgtggaggcgatgccgctgtcggagcggccggatgcctattacgaccatgtgctgacactgtttggccagggttggcagcaaggccgatatcagttcaacgcgaatggcgagctcaagccggcctgggagggcgcatgcgcggcatcctgagcgccatgttggcggtgggcttcagcggcgcgctgcatgcggcgccggcggcggtggatccggcgcaggcgctgctggagcaggccaggctatggcaatcgctgggccggccgctggaagcgcagcaggcgctggacaagctgcagcgcatccatgccgccactgcgcaggatcgcgccgaggcgctgaccctgcaggcgctggtgcaagtgcagcagcgccaggataaggacgcgcagcagacgctggccaaattgcgcaagctgtatcccggctattccggcatcgcccgcgtggagcagatgcgccgcatcatggggccggaccgcaacaagctgctgaccgcgcgctccctgttcaacagcggcaagatcgaacaggcttacgccgcattcaacgcgctgtaccaggggccgccgccggaaggcgcgctggcgctggagtactggcaattggtggcgcggctgcccaatggcggctgggcccgcagccaggccgagttgaaaaagctgatccggcaaagcccgtccaatcaccgaaaccgcctggcgctggccagcatctacctgctgcacccgccggtgccggcttccgtgctggcggacctgaaggcgctgacgcaattctccgacagccgcagcgaggcgctgggcttgtggcgccgcgcgctgcagcagtccgacctgccggatgacgcctatctcgcctatctgaaggtggagccggaggacgaattggtcagctcgcggctggcgtcgttgcaggatggccggcgcaagcggcgcgaacagctggccgacccggcttaccgcgccttgctggcggccgacaagcagctggacgccaaccagctggcggcggcggaaaaaagcttgcaattggcggccagccgctacggcaagcaggccggctatctgcaaagcctgggccggctgcgcgagaaacagggccgctacgccgacgcggtggccagctatcgccagggccaatcgcaacagccggacgacaagggctggaagcgccgcatcgccgacgcccagttggccgacctgcttgcgcgggcgcaagcggcgatgcaggcgggacaatggcaggcggcgcgcgcgcaattggaccaggccggcaaacagcagcccggcaatgtcgacgtgctgctggccgacgccgaatggcaggcggggcagaagcacgccgtccgcgcgcgccagctgtaccgccaagccttgcagagcaagctggacagcggccaggcgctggcgggcctgctgcgcacctatctggatgccggcgagtacgcgcaggcggccgagatgctgcgcgcgctgccgccgaagcagcagcgcgcgctggggacgtcctaccagtcggcccgcgccgacgtggagcgcgaactgggcgaccgcctgctggcccagggccagctgagccaggcgctgccgcatctgcaaaaggcggtggatttgcagccgcaaaacacctggaaccgctacgcgctggccaacgcctggctggcggccggcgacgcggccaagggcggcgccatcttgcgccagctggccgacgcgccggccgccagcccggaaagcctgtacgcctacgcgctgttccaggccaagcgggaagacgatcgctcggcgctgggcgccttgcagcgcatcgcgccggacgcgcgcagcgaaggcatggcggcgctgcagcgccgggtgtggctgcgggaaaccatgcgccaggccgacgcccagctggctttcggccatgcggccgaggcgcggcgcagcctgcaaaacgccgaacgtctgatgcgcggcgatccggcgcggctctccgagctggcgcaggcctggctgcgcgccggcgacgccgagcacgcgcgccagatgctgttgacgcaatatctggaacagcccggcgccgacaatgaactggcctacgccgacctgctgctggacctgggcgacgcggcggcggcggcgccgttgctggcggcttccgcccagacgcggcaggacatgaacgatgagcaaaagcgcaagctggccgatctgcaggccgcgctggcgtcggcgcaggcggacgcggcgcgggacgccggagatggcgcccgcgcgcaagccatcctgctgcaggcggccgcggcggctccgcaggacgcgcgcctgcagcgcaagctggccgattacgatatggacgccggccgctggggcagcgcgcgcgcccgcttgcggcaagtgttgagccagcagccggacgacgacgaggcgcagctccaactggtggatctctacatcaagaccggccagcgcgacctggccgtgcacggcgtggacgcgctgctgcgggacaagcccggccgcagcctggacttccgcttgcgggcgctgacgcgcctgggcgacgccggcgagacggagcggctggatcgcgaaatcgccgccttgctggcgcagggggtgaagagcccggcgctgatggggcaggcggcgcggcgcgcccggcagcaggataggccggcccaggcgctggcctggtatcgcgccggtttcgcccccgccggcaacgaagtgcagaccaccgccaacagcggcctgctgctggggcagcagccgttgcggccagtgccggccgaatcggcgcagcaggaaggcttgcacgaagactacgccgaattgctggacgcgcgcagcgtgaagatctggcaggggctggacctgacctaccgcagcgccgacaacggcacgccgggccagtcgcagatgacgatgtggcaagcgccgctgctggtggaattgccggccccgcgcgcgggcaagtacttcctgcgcgccgacgcggtcagcatcaacgccggctcgctggacaacagcctgggcaacgattacgcgctgcagcgtttcggctcggtcgccgcctgcgccgcgcagtccggcagcagcgtgcaaagctgcgccggccagtacggcgcgcaaaccgcgcaaggcgcggcgctggggctgggctacgagaacgagcattggcgggtggacgcgggcgtcacgccgcagagcttcccggtgtccaatctgatcggcggcgttcgctattccgacagcgtctccatcctgaactacaagctggaggccgcgcgccgcccggtgaccagttcgctgctcagctacgccggcgtgcgcgatccctacaccggccagacctggggcggggtggtggccacaggcgtcggcggcagcctgggctacgacaagggcggacgcttcggcgtgtggtcgaatttcgcctatcaacagctgaccggcgaaaacgtggccgataaccgcaagctgacggcgatgggcggcgtctactggcgcttgctgaaggagccgacccggcaagtgacggtgggcgtcaacagcatcaatttctggttccagaaaaacctgggcgaattcactttcggccagggcggctattacagcccgcagcgttacaactcgctgtcggtcccgctcagctacgcggcgcgcaatgagcgctggagctggctggggcgggcgtcggtttcggtgtctagcgccaacgaggcggcgtcgccgttctatcccacccggccggacctgcaggcgcaggcgggcaatccgtacgtcagcgcgagttcggggccgggctggggggtgtcgctgagcggcgcgttcgaataccagctgacctccaggctggccctgggcggcatgctggagtaccagcattcgcagtactaccagccggggcgggcgttgttctacctgcgttaccagccggacggcgcgtcgctgacgctgccgttcccggtggagccgctgcagccgtattcgagcttctgaggagaatgacgtgaatctgctcaaaatggtgggctgttgtctggccatcgcgctgctgccgcaggcgggcatggcggcatccgtcgagctggacgccgcgcgcgcctggtactggcagcacccttaccagccggaggcgatcaaccgcctggcgctgcaactggtcaaggcaggccaaaccggcagcgccatcgtgctgctggagcgggcggcgcgcatcgcgccggaccgcgaggacatccgcgccaacttgctgcggctgcagtccggttcgcgccaggtggtggacgcgccgtgggccgggcagggcccggagccggccgatgccgcgccaagccagcccctggcagcgcccgccgccgccgaggccttgccgccgccctggcccatgcccgccgccaagccatagcggcaggatgcttgcgaaatgccggtcacggaacgcgtggccggcatttttattgtccgcgcgcctgggcggggcgtaaaaaagcggccctggacagggccgctttgtggcgggtggggccgagggggcgattattgcaccgggtactcggtccagtcgccgccgtcctgctgcaacaggaagcgcttgccgctctgcatcacgatggagctggcgctttccgaaacataaggcgtcgtcggcaggtcgcgcgcgaactcggccggctggtagtcggcgccgaacgggctcttggtcatcatccgcgacaggatggtggacaccgccagatagctgctgggctggtcgatgcggacttggctggggtgggcctggccgcctatcaccttgacggccgccggcacgatggtgatgtgcggcgtggggatctcgcgcaggccgctgaattgctgcttgtcgccgcgcagcgcggcgccgtgttccggcaccagcaccagcaccatcttgcgatggctcttttccagttggtcgatgaactgggacaggtcggcgaacagccggttggcccggtatttgtagctgtccatggtgttcagcccgggcgcgctggggatgcggttgccgtcgtgcaggctgatggtgttgtagtaggtggccacgtgcgcgctgctgtcctgctggcgttgctccagccagcggttgagcaccgcgtagtcgctatagatgggcgtgttgtcgaaggagcgcaggcccaccggcaggccctgctgcgagatcagcggctggttcagccggccgtcgctgcggatctgcttgaggaagtcgtcgaagctgccgtcgtggttcatcgtcagctcggtcttgaagcccagcgccgccaggtcttcaaacagatagcattccttgggcgcgctctggtacagctcgctgtgcttgggctggccgcagctggcgcgcagcacgcgcagcgccgccgggccgctgtacggggtggcggagttgaaattgctgaacaggaaatcgaaacgcccaagcagcgggtgctggtccatgccgatggcgcgcaggtcgtcccaggacagcgagcagacatgcaggatcagcacgtcgaagcccgggtcggccagcggcccctggaatttcaccatgcgctggccttcgctcttgaagaaagcggccagttgctggtccggcgtctgcgcggcgttgggcgcggcgcccgcagtcgccgcgccgctgtcggccaccgcggcggccggcgcgcgcggctgctcctgccacagctggcgtccgctcagccccagcagggaaatcatcacgatggtgcccagccgcaggtagcgcgacaacagccaatagccgcacagcaggatcagcgcgccggtcagcaaggacagcgacagcacgcgcccggccagatccagcaggtagtggaagctgaagccttgcagcgtggacagctgctgcagcgccatcgacggcgagggcagccagctgtcgtggtaaagcagcgcggcgcccgccagcagcgccagcgcggcgcggaggcgcaggcgcgtcttgccggagatcgggatcagcagcgccagcgcgaaggcgagattaggcagcgggtgcaggttgagcgtgccctgccaggacagcagcagcttggcgatgaagtagacgctccacgtgcccagccccaaagagcggggggcggcgggcgcgacggtgtccggcgtggcggattggctggatttcatgatggcttgtggcccggatcggcgcgccggctcttggccagcggcgcgtcatcctgctggcgcaggcgttgcagataggggtggggttggaagtggcgcatccggcgcgacagcagctcgcgcagccgcggcagcagccgggcgtgcagctggtaaccggcgatgccggccgccagcgccgccagcagcaccagaaactgcaactggctcaattcgggattgaacatatcggtcctttattggctgccgtgccgccgcagcggcgcgcgttgcagggtgggcggcgtgtgcgcgtggcggctgtcgcgcgggcgcggcgcgtccgacagctggcggctgaggtccggcagcttgtcgaagccggactggcgcgacagctgcgacagcgccagctggatgctttcgctgtccgcgctgcgcacctcggcctgggccacttcgcctatcggcatgcggaacaggttgcccagcgcggcgtcggcgtcggcctcgcggcaggcgaacaggaacaggtaggcgtattcgccgtcggcggtgcacaggtcgccggcgcgctggaagcgccccagcgccagcagttcggccgggctcgcgcccagcgccggctgcaggcggatgaacatattgctgacatcgatggcgcggctgcgctgcacggtgccggccaccacctcgacgaaacgggccggcggcaggtagccgcggtcggcctcgggccggctggcggcgcgcagggcgtcggcttcgacatgttttctgccctggtacaccgcctggcgcagcgagtggacgatgctggccaggctggaaaagcgcagctccgccggcagcaccgcgttggcgcccagccgcagcagcagctgttcctcgttctggcgcagccggcggttgcctacctcgcgcactacgatcttcaggcgcttgccgcattgctggcgcaactgcgcgacggcgttgcccagcacttccttcttgctgctggcggtgtccagcagcacggtggccgccaccgcctcgcgggcggcttccagcaactggggcaggtcgtcgaacagccgccagtgcggggtgggcggggtgttgccgctgagggctgcgttggtggccagcacttgcagcgcgtcggtggcgagccggctgtggccctcggtcgcgtcgccggcgtcttcttcggcttcgcgctgcgcgctgagcaaatggcgcgggctcagctccagcgtgcgcagcctggcggtttccgccggcccggcgcccagccagtgcgcgatctgccagctatagaagccgtcgcccagcggctgcgcgtacaccatgccggcgcagtcgctgcccagttggctgagggcggccagcgcggcggcgtccagatggctgctgtccagcagcaacagcagcgcatggccatgccgcgccgcccaatggctgcaggcctgcagcgcgcggcgcgccagggccggctgctgcaacggcagatagtcttcggcgtggtccaacgccacggtcatgccgccgccggcaggctgcagcagcttgcggcagcgcgccagctcatccagataggcgtcgatttgctgagcggaggatttgcgcggcttgcgcggggagagcagatgcagattgccggcgtggatgcggcggtccagccaggcggtgtcttgttgcgcggcgggttgctgccggctggcgcagatcagcggctggctgccggccgagggcaggttggcgaacagcagcgcctgggccagcgccgggccgggcgcggcgatcaggtaaagcgccccgccgttcagggcggcggcggacggcggaatcccgtctatgcccaggctttgggtggtgtccattgcagtattttgattccagattatttaaatagtatcagccgcatgcttttcaatcaaaccacgccgcggcttttgccatctgtcatgcctggttggagtgtagcgcagcgcgccaggatgtcgccgcgcgcggggtcaaggttttttcagccagatgccgagataggcttggcgataagcctggtcgtcttcgatgtcgccgtcgcgcgggtgggccagcagcttgtcctgggtcaccaggatgggcttgctgacgaagccgctgggcggctggcgggcgaagccgcggttcagttcgtccgccatctgccagccttgttggttgcaaggttcggccacggtggccttttgctgcgagatgccttcgcggatgcggttcatcgccgaattggagccgtcgcccgccgagatgttgacgatgtccggccgggcggtctggtgcagcggaaagttgatgttgtcgaagtacagatcgttgatggccagcgtgtgggtccaggccgcgccgtatttctgcgccagccgcggcactcgttgcgggatcagctgcgcggtcttgctcaggtccacgtcttccatggccagcaccttgcagcgcttgcagcgcagcagcgcgtccttcatcgcgttggccttgcgcatggcgatggaaaaatgggagtcggtgaagatcactgcgcccaacgggccggtgctgctgccaatggcgtagctgaccgcggtttgggccacggcgatggggtcggtggtgacgttggcgaacagctctgcattgggacccgggctgctgccggcgtgccagcccaccgcgaccttgcccatctgcttgagcaacgccagttccaggtggtagccggcgctgtcggcgcccaccagcgccactccggcgacgtccttggcggtggcttgcagcagcagttgttcacgcaccgagtcgttgctgcttttggcgtcggccaccgtcacccgccagtgcagatagccggcggcgttgagaaagctgcgggtggttttggagatgccgccgttgcgcagatcgtaggcgatcaacagcacatggcggccgctttgcgccggcgggcctgcggccggggcgacggcgttcggcgcgggctccgccggctgagcggcggaagatatcaggagggaaaatgccagcagccgcggcagggcgcggcgcgacaaggcgcgcagacaaggtggggaggatgcgcgcaatcggctggccggctcggcttgggtcgtctccatgctcaaatatagcaagcggcctgcccgttgccggacaggccgcctgtggtggcctgaactcgcttagccgtgggacggattgcgatagactggagccccgttcagccaggtctggcatacggttatgccgcgcaggtcggtcaccgcgtcgtcaagcggattctggtccagaatcaccaggtcagccagcttgcccggctccagcgaacccaccaggtggtccatatggcactgccacgcggcatccagggtcactgcccgcagcgcttgctcgcggctgaggcattccgccggattcaacggcgcgcgctccttggccggcgccccttccatcgtgcggaagatggcctgctccatcatgcgcagcgggccgaagggagagacgaagtgatcggaatgcaggctgacgcgcatgccggcctgaacggcggactgcgcccggtccagcagctgcgcgcggcgatttcccagaatggtcttgttgaaggcatagccccaatagccgacatggccgatcaggaagctggggcttaccttgaggcgagccatcttggcgattgcgcgatcgtccatcagcgaggcgtgctccacccgcatgcgcaggcggcgcttcttatccgcggcttcagaggcgggggccaacgactcggcgtaaccgttgagcacatcggccatcgcgtggtcgccgttggcgtggatcaggatcggccattcttcatcactggccagttggatcagttccgccagctcgccgggttcgagattgtgcaggcccgtgggcggaacgtccggcaccggatgggcttcggcgcacggatagggttcgttctgataaccggtcaggccctggttggagccgtcgtatatcagcttgatcgccttcagcgcgaagcgcttgtccttggcattgtccagatcgggtgtgatctggagctctttccagtgttgcatcctctccttgtccggcgtgaacagcgccgcggcgatccgcagcggccccccatgggcggccagcttcagcaggtcgatttccagcttgctgccggatacgccggctcccgcgtccagcagggtggtgatgccggtctgcgacgcatcctgcagcaccttcggaatctggagcacggcctccgcccagacgatgggcggcatcgccccaagcagcgccttgacccggtcctcggtcagcacgcccttgctcggcggcaggctgccgtcaggattcagcaaccctgccttgcgcaaggcaggcgtattggcataggcgatgtggccggatgcgttgatcagggcgataggcgtctgttcgctcaattcgttcagcaggtcggcgttgatatcgatccattccttcatcagcgacggatcgacgccgaagcccagcacccatcggtctccttgcgcatctttcggcaatttggactgggagagcgcctcgcgaatctgcgccgagatgctttcgtaactgtattgcgggtccaggcgctggcctttgaagggcgccagcggcagccaatgccggtaaagcgcgctgggcagaacatgggcatgcggatcgatgaggccgggcagcagcgtgcggcccgccaggtctatcctgtcataggcctgtcccggcatttgcgcttccatcgcggtttccaccaattgcagggaaccggtggcgacgatgacgccgtcggcgatgcccagtgcctccacgcgctgattgccattggcggcgaccgtataaatagggccgccgcagaaaaccgcgcgcgccggggtgtgcgaaggaatggcttgcttgagcgcggcttccagggcttgcagcgcttgttgaggatcggggaggttgtcgaacaacgaaggcagatgcggcatcgagcagcaggcgcagcctagatgatggtgttgtgtcatgtggatatccttgtttcgtggtgtttgaaattcctttggcattgcaactaaaagattaagcttttttcattaaagttttcaaatgcatggtgtggaagctgtcggatagggcagctggcagcagcttgcgctgccggaatcgcggcgccaagctcggtgaatggctgaaaaagaggtataatcaggccatttttccattcaaaaaatcaagattaagcaccatggaacttgccaagagctatgaaccgggcgacatcgagcgtcgctggtacgatcaatgggaacaggccggctacttcaagccgagcatggacaccgccaagccgtctttcgccattcagctgccgccgcccaacgtcaccggcacgctgcacatgggccacgccttcaaccagaccatcatggacggcctcacccgctactaccggatgaagggcgacaacaccgtctggattcccggcaccgaccacgccggcatcgccacccagatcgtggtggagcgccagctggccgaccagggcctgaaccgccacgacatgggccgcgaagcgttcaccagcaagatctgggaatggaaggaaaaatccggcggcaccatcaccagccagatgcgccgcgtcggttgctcggtggattgggaccgcgaatacttcaccatggatgacacccgcgccgaggtggtgaccgaagtcttcgtccgcctgtacgagcagggcctgatctatcgcggcaagcgcctgtccaactgggacgccaagctgggcaccgccatctccgacctggaagtggtatccgaggaagaagacggccacatgtggcacatcaagtacccggtggtgggcagcgatgaatatgtcaccgtcgccaccacccgtccggaaaccctgctgggcgacgtggccgtggccatcgccccggatgacgagcgctacctgcacctggtgggcaagcagctggaactgccgctcaccggccgcaccatcccggtgatcgccgacgagtacgtggacaaggaattcggcaccggcttcgtcaagatcaccccggcgcacgatttcaacgactacgaagtgggcaagcgccatagcacccagctgatcaacgtgatgagcctggaagccaagattctggccaaggcgcaaatcttcggcttcgacggcgccgcccaaggcaccatcgagctgccggccgcctacgccggccttaccgcccaggaagcgcgcaaggcgatgctggccgatctgcaagcccagggcctgctgctggaaaccaagccgcacaagctgatggttccgcgcggcgaccgcaccggcaccgtgatcgagccgctgttgaccgaccaatggttcgtggccatgaacaaagtcgccgacggcgacgccaccggccagtccatcgccgccaaggcgatcgaggcggtggagtccggcgaagtgcgcttcgtgccggaaaactgggtcaacacttacaaccagtggatgaagaatatccaggactggtgcatctcccgccaactgtggtggggccaccagatcccggcctggtacgacgaagacggcaatatctacgtcggccgcaccgaggaagaagcccaggccaaggccggcggcaagaccctgcgccgcgaacaggacgtgctggacacctggttcagctccgccctggtgccgttctccacgctgggctggccggaagaaacgccggacctgaaagccttcctcacctccaacgtgctggtgaccggctacgaaatcatcttcttctgggtggcccggatgatcatgatgaccaagcatttcaccggcaaggtgccgttcaaggatgtctacatccacggcatggtgcgcgatcacgaaggcaagaagatgtccaagtccgagggcaacgtgattgacccggtggacctgatcgacggcatcgcgctggcgccgctggtggaaaaacgcaccaccggcctgcgccgcccggaaaaggccccggccatcgccaaggccacggaaaagctgttcccggaaggcatcccggcttacggcaccgacgcgctgcgcttcaccatggccagctacgccacgctgggccgctcggtcaacttcgacttcaagcgcgccgaaggctaccgcaacttctgcaacaagctgtggaacgccacccgcttcgtgatgatgaacgtggaaggcaaggactgcggccaggatgaaagcctgccgctggagtatagcttcgtcgaccagtggatcatcggccgcctgcaacaggccgagatcgacgtcaccaacgcgctggaaacctaccgcttcgacatcgccgcccaggtgatctacgaattcatctggaacgagtactgcgactggtacgtggaactggccaaggtgcagctgcaaaccggcaacgacgcccagcagcgcgccacccgccgcaccatcgtccgcgtgctggaagtggcgctgcgcctgactcacccgctgatgcccttcatcaccgaagagctgtggcaaaccgtggccccgttggccaacgccaagaaagcggactcgctgatgctggccccgtggccggtggccgacgagagcaagatcagcgcggcagccaacgcccgcatggacgcgttcaaggacatggtcaacgcggtgcgcaatctgcgcggcgaaatgggcatcggcccggccgtcaaggccccgctgttcatcgaaaccacagacgcgtccatcgccgacttcgtgccgtatctgaagctgctggcccgcctgaccgaaggcacgctggtgtccaagctgccggaagacgatgccccggtggcgatgtccggcgaagcgcgcctgatgctgaaggtggaagtggacaaagccgcggaaaccgcgcgtctgaccaaggagcagggcaaggtggaagccgagctggccaagctgaccgccaagctggagaagccgggttacgtcgacaaggcgccggcgcatttggtggagcgcgataaggcccagttggctgagttgaatgacaagttggagaaggttagggcgcagttagtgaaactagcttgattatttgccattgtcatgataaaaaagccgtcatcgttgacggcttttttattggagaaaagatgagaaataaaaagattgaatttgcaaatttggtaattagaactgatgaatctgcaatgttggacttgttcgatgactttattgcgccagctttttttggggatgctttgattaggaagtatggtggtgtcagctatatattccataatgtaagagtaattaatgcctcgcagggtgatgggcgtgttgatggggcgattgttggccgattggtgaaggatgaggatattaaaattgagcagaaacttatagatgggagtttgcttgaggctgatgaggtttatcagcgagcgccctcatctgtttttgtgtttttttttaaaggatcatcgccttgcttttgttcgtgagcatgcagggtccccaggattgcaggcttttaaatcgactattcagttttttataaagaaaatacatggggtatttttaaaggataagattgaggagttgcttgaggatgtggcgaggagtgagcgggttgcaaagcgggcagagataaaagcattaattcctctgccttcagttaatcttgtgccattggaagatgcaagaggaattgagcaagcaatttcatcaatggattcaattcgtgatttgatttttgatgtgattaggactaatgacgaatttaacccgggggaattttttgatgatgtgcgagatgtaaaggttggcttaggtaatcctgagaaggcagttgtgcgatttggagatagtaatcaaaatattaatcagcaagcagcagcccggctggtgaaaaatgctgttgaggaccaaaatgttatatacagagttgagggaacgggccttggtcagcgattaaaatactccaatagtttagatgggcaagacagtgatgttatcagtgtgtctgcgcctttgcctaatgaggaggtaagccctagccagattgctaggcgtgctgtgatggagtatcagagaatgattgatagtggtgtaattcgtgaaccagaaatgcaagagcctgatgaaatagcaagaaaagttgcagatataattgcacgttatggcggggagcgcgatggacaatgatcaagatagactgctaagagagataacaaaggaggggaatttttggcagctgtttagaatggctttttcagttgattttacactgacaaataaattagtacctatttttacttttgttgttgtttttcttgtgaatattccagtgggagggcaggggctatcattcgatgatgtggtttcttcagcaagggattttattggatggaattttactatacttggtttcatgattgcaggatatgcaatatttacaacggcaactagtgcagaccttagcttggctcttatgaaaaagcgtgagcgtgttacgggcttgccatacttaaaatttattcatgcagtttttttaaaggcgatattggtttttttgcttgcaaatgttcctccattgctttgttctgagtttgttaaaaagaccgggttgattagtatgctattttccgatttaggtgagtggcaaggttattgttttgcattctttcatgctatgaatgtttctctctttattttggcactggcaatgcttaagtcatatattttcaatatttatgcttcagtgatgatggcagttagatggtctgcgcgtgattgatcttatggattgtgtagagagggccgcaggttgggctgaatgcaatgaggcctaacgtttatcgcgttggtttgtctgcttttttgtgtccgctacgcggacaattgtttaggtgccggttcctcccggcgtgacgggtccatttcttttgctccgccaaaagaaatggacgaaagaaaaggcggccctgggcgcttcgaaaccccggtcaaaacaacgcgccccaggcgcggccgaactcgcaccgcgctaacgtcgcggtgctcaaacagacggccgcttaaaacctggggcgcattgttttgaccggctcgcgccaagggagcggggctcgttgctcacactctactgggcgtgcttgttgcaagctgcgtgtggttgctatgcggcggaactctcggcgttgccgggattccgccctacgtagggcggatgccccgaaggggtgatccgccgcagaagataagcccatgttgtgtggcagccaatttgcccctgcatcccgtgcggaaagtggcacctaaatcattatccgcgaagcggatacgaaggtcttttctacacttcttgccagtctcgatcgtggaaaccctgattgatctggcgctaagacgcatttaacctgacgcagtcatgcttgaccgcatgaccgggtttggcgacctgaactacttggatcggcgcgctgcttcgcagcgcttcacaatcttgatggagttctagccatgacccagttggcgcactctcccatgcagcctgggctgctgtcttttcccttccttacgcacactatccgccttctgcatcgccacaacggcctgtggttcttcgccgatgacgtcgcggcggcgatcaaatgccgcagtacagcggcgctgctcagcaaactcaacagagaagaagtccgcaccctgccggtaggcgtggaggatgtggtgtgcctgtccgaaaccggcgtggccatggcgattcggcgctatcgcaagccggcggcgcggcggtttcggcgttggttggaggaggagttgctgccaactttgtggcgggagggcgaggaggcgttgacggcagatcagttggagcaggccttggcgctggcggcggaggcggcgcggcaggtgagtcgggcggtgctggatgcagtgttggagaatggcgaggcgtgctggcagcatagccgctggctggtgacgctggactatgagcgccataatcgccagaaacacccgctcggccgcatgatgggcctgaacagcgctgtttctacattggacggcttagccgagttgatcgccgtgccggacggcatgccggcgaccgataccgagctggtgaaactggccgccgcttgccatctgcggctggccgagcggatgagcctgcgcgtggcggatgagtaacatagggtgcgtcaccacctccccaggcggtacgacgcaccgtttgtttccatatctctcaaatattgattcggcaagatatatcggcggtgcgtcgcccttgcgggtgacgcaccctaccattggccgagtggatgagcttgcgaatgggtgaggcatggtagatgccggagcaacgcaccgtttgtttacaaagcctgaacccattggccgtgtcgtggtctatttacttaatgctgctatgctgtggctagtgcagcctccatgctggtttctcgattgctttccctgaacggttgtccgccttgtcccggccaggcctttgctgggcggggcctgcggccgttcgtcaacaataaggaaaatccattgattcacaacacgattccgcgctggaccattgtcacccctgtattggcctgggccgccatcgccgcgtcttcggcggccggtgggcatgcttcctatctgacgctgctggcggtgttgctggcgggaacggtattcgccgccgtgcaccatgccgaggtggtggcgcataaggtgggcgagcctttcggcacgctgatcctggcgctggcggtgacggtgattgaggtggcgctgatcatttccttcatgctgggcggaggcgaggagaagctggcgctggcgcgggacaccattttttccgccatcatgatcacctgcaacggcattctgggcatttgcctgctgctgggcggcttgcgccatcgcgagcagaacttccagcttagcggcgccaaggcggcgttgacggtgctggcggcgatttcggtgctggcgctggtgctgcccaactacggcaccagccagccggggccgttgctgtcgtcgtcgcagctggcgttcaccggcgtggtgtcgctggtgctgtatggcgctttcgtgtttgtgcaaaccattcgccaccgcgattatttcctggtggaaggcagtcatgacgaggacgagcacgcgccgccgccgtccaacaaggtggccatgctggccgtggcgatgctgctgatttgcctggtggcggtggtgaccctggccaagctgctgtcgccgtcgattgaaagctttgtggtgaacgccggcgcgccggcggcggtggtgggcatcatcattgccgccctggtgctgttgccggaggggctggccgccgccaacgcggcgcgggcggatcgggtgcagaccagcctgaacctggctttgggttcggcgctggcttccatcggcctgaccattccgacggtggcgatgattttcgtgttccggggcgagccgctgatcctgggtttggaaatcaaggaaaccatcttcctgttgctgacgctggtggcatgctccttgtcgctatcggtagggcgcaccaccattttgcagggcatcgtgcatctggtgatcttcgcctctttcgtgttctttgcgatcagcccctgagcgagcctcgatgagttgaaagcaaaagccgccggcatctgcgctggcggcttttctatttggggctgctgccatttggccatggccggccaggtagggcgcgtcccccccagcggggcgacgcgccttttatttcccattctcgcaagtgttgattcggccggacaggcggtgcgtcgcccctgcggggtggcgcaccctacgggtgatcgcttgattctttcggttcgccaaaccattgcgccaagatgggcgtaatctcctctgcatcgggcgaggtctcgctggcccaggctacaaatccgtcgggccgaaccagaacggcgcgcaggccaagattgtttttgaccgtggccgtgacatagtcgacgcgtccttgccagcgcttcatccagtttagaaggggcgcagctgcgtcgaaatgcagcagcaagccccggccattgcgcaacaggcggccggccttcgtcccgtcgtcaaactcgaagtccggcacgctgcggcctgccagcggatgctggcttgccatgtcgtagcgcagggacagtccccatacccgctctgcaaaataggtcgcgccatctcgggtttcgatcaaatcgccgatgatggctgcgagcgcgcgcgtgcttggcgtggggcgcatcagcgccacctgcgcgcgggaccaatcgagcacgcgggcgccgattgggtgccgctcttgctgataactgtccagcagtccggccggcgcgtccccgcgcatcgtcgcggccagcttccagcccaggttgatcgcgtcgcctatccctaaattcagcccctggccgcccaggggggagtggatgtgcgcggcgtcgccggcaagcagcacgcgcccccggcgatatgcgcttgcctgataagcgcgatcggtccaggtagtggcaagccgaatatcggccagggtcgcatcggcaccggacacgcggcgcagtacggcttgcatgtgttcctgagtgagagcttgcgttcgatggcaagcgccgccgtcgaattcaaccatggcgatcacgccgggcttggcataggtgtacatgccggttggcgtatagtgccggccgggttgaagcgtgtgcggctctgctaatgccgcgtccacggagtagccggtgaactcgggagcggtgccaaggaattcgaagccgccagccttgcgaacctggctgcggccgccatcgcagccgatgagccagcttccgttaaaaaccgtgccgtcggcgtgaaccgtgacctcgtcgtctgaaacaagatagccatcgacaccgacgccgcgcagaatcgtcgcccccatggcggaagcacggcgtgccaagaccgtttcgaagacctccaatgtgattgccatcggagtgtcggcggggccaggcaaatggaaaggccaattcgaggtgtcgatgtcatcgagatggaacggtatgccggcgaaatgtccggcagcgcggcgcggttgctgcatccaatgggcgcttgcctttgtttgcttggctgcatcgttggcctgagtcgcggcgatgatttcgtccagcaggctgcggcgatgcagggcttcaagggtgggcaccgacagaccgcgcatgccaaactgaaggcgctttagaggggagtgtgaatccgcagcctgctctagcaccagaaccgaaaggccgaagaggcgaagttcgcaagcaagaaagagtccaactgggccggcgccggcgatgatgacgtcgtaaggggtgggatgatgattgcgcatgaggagctccattgtcgatgttcgaccggagcgttccccactttgagacccgcacggacgaacgacgggacgcttgtagcgtctgctgttcgtcgcggggatcttgtgcgcgaggccaaagaccagagctttcgttaccgaaaggacttgggcctaccagaccaagtctgccttttccgacgcggatttataccatggcgatgcggcggcgtgcaatgacgggccggcggcggatgccggcaggctgggcgcattgggggggagcgcggggagtggcggcgactcaggcgtagtcgtctatcgcgcctcgcggattgcgttgccggcttgccgggctgcggccgtcgcttgtgcttgagcgtgcctcttgctgtttggagttgggcaagctgggcctcaagttgggcaatttcctgttctatccggttcgcttgtttttgctgactttcctgcgagctttgggacccgccctagccgccattctgcagttgctgttccagttgttgtatctgttgctccagctggctatcgaggcttgaattgtctgtccgcgcggctgcggcgggcaatgatggggagatgctgtttatcgtcgcggcatcctttgtggctgttggcgcggcgctggtgaaggcaacggccaaagcggagcggacattcaatattcgattaggaaattcacatgtcaacctctgtggtatttatttttactttgtcacttaacggcgggcggacaggcaggcggggaaggaggctgggatgcgtcccgtggcgggcgacgcatcctacccggcatgcggagtggagtttgccggtttaattgctcaatggcaccagcgtgaacgattcccaatcattggctgtgcgggcatcgctatggacagggacattattggcgccgccgatgccaccattattgacgaaggtgacgtagttgccattggcggttttcagcgcgtaagtgttgctagccggatcaaactccagttggaagcgttcccaagtgcttgcccaggtggcgtcggtatgaaaagggctggcactggtgttggggccgcccacgccgccgccgttcaccgcagtcagatagtagccggcggtggtgcggaatgcgacgcggccattgggcagttgcaccagatagagcgtttcccatccgcccttggttttggcgtcggaatgcagtgcgactgcgctcgggccgttgttggggccgcccaagccgccgccgttcactgcggtcaggtagtggccattgctggtttgcagggccagcgggccagaaagggtgacgatgggagcggcatcgctggcggtggatgcgatagttagagagatggctgcaagcaatgctttgaaggttttcaaattcatcacgatctccagaaggattggtttgcctgaaggctctggcaagttaaggcaaagccgactttatgacaaatgaattttaatgaaaagcggagaggcaattttgatagccctggctaggaggtaaatcttcgccaggcaacttgatgcttatgggaggggcgggtggccgtgaggtgattgcctgcgttggccggcaggcgatgggcggcgtgattcatctgtcgatgccggatatagcgcgccatgggcgtagttgtggcagcttgcgctggcggagagcggttgtcggtgccagcgtaggcttggtcagatggtggtgatcaacgcatcggcctgatagctggcggtggcgatgccggaggccgagctgaatgttatctggaagcggcggccgatctgctggatagacaaaacttcgaacgatacaaccagattgtcgatgtgctgggtgatcaggtcaccctgtttcagttcctgaattttcatggtttactttctgctttccatgccaatagcatggcgtggaatgggtaaaacgagtcctaacggcaaggacgctttgcgatattttcatgagttgtgcccggatgtcgtggggggctgcgaggcaatggatttcatcgccgtcaaaattcagagcgctggcgctgtgcggcgtgaaacggtttgctggctaggcttgtgacaacaaccttcgcgtgccaacggctgatttactggaaaactgaggctgggcttgagaagaggagcgtgacggctcgtgcgagcgctacaacatgaaacaatagcagaaaattatgctggtaattttctgatttgtcaagactattttcctgcaggcctggggcggcccggtctgtccgaagccagccatccgctttcgcaggcgtgcgcatctgcacaggcgccgtcgcgatggcatgaatcgctcgcgcccattgggttgctcctcttggcaaagtggccatgtataagcctggcagttgggcggccaaaaccggtttggattgagtggggctctcttcgtctggtattcagtggcagtatttcttcaggatttgattgccattgaggagcgtgaagcctatcgcaggcgtgccatatgcttcttccagccgttggctttcactttcggccatgtcatatcgtggataaatggatgaggctaatatattctcagcagtatgaacggaccagcccaggaataatccagttgaaccacgctcgcacgcaatatgataaattcgcattgggtactccttccaaaatatctcttgataggtagattgtgcctcgttttgagcgctttcttctggtggcatggttgccatgccgcttgtcgcgctagcgtgctaagcgatttttttgtgatgatagatcacgcgatttccgccctgcgccttcgctcgatacatagcggagtctgccagcgccacaagattgtttggagtatttgcatctgcagggtaaatggcgatgccaatactggcagtcggaaaaatgacgctgctgggcagtgtaatgggttggcatatcgagcgtactattctttttagaatcatcgcgtattctgagctttttttcaggcccataagcaataagatgaattcatctccgccaagtctggcagcggtgtcgccagccctgatggtagagtctagtcgaatggcgagctcttttaaaacggcatcgccacattgatggccgtgcatgtcgtttatcgctttaaagttatccaagtccataaagcagactgcgaggaaagttttattccggtctgcttgagagattgcctgaatcagtctgtcggtgaacagtaggcgattgggtagccccgttaatgtatcgatgtgagcgcttttggttattgcggccaagtcaattttttgttgcgtgatgtcactcatgattcctatgtagtgggatacttcatgctgagcgtcatgaacagcagaaatattgagtctgatggcgtataaagaaccttctttatttctattccacatttcgccttgccattggccatttttgttgatggattcccacaccgagtcgaaaaaggctttgtcatggatgccggaagaaaatagattaggtcttttgcctgctatctgggtaagactgtatcccgttattcggcataaggtctggcttgcctgtagtatcttctgctggttgtcagtgatgcatacgccttcgctgtggctgcggaaaagagaatcggcaagttttagtctggcttgtattggccatgttttgcaagggtcgtcgattttctccgtggaggatatttttgcttcttcatctaaccggcgcatgggggatcctttcaatcattcagcccccatgttaattgttcattttttatttcaatctgcaagtttatgggtttgtggcaatctgtttttatggtgcgtgtggcttatatgattgatgttgtagattgaattggttggttaaatagaggcttgcttttcggtgagtctattctcgtataaggctacgcgctgctggggtgtttgtaagaatttttatttgattgaaatctctgtgattattgctatttttcgcaatttttatgggtggggaaaagcagtatgcgctttttgctgtggtgtgtgattgatcgatgatcaatttgaatggcaggtcgattgtgataaataggccaagaccttgtccatatctagacatccgaacgtcaagggcgaaacgccaggatttgccgtttgagtattttctgggtggtattcttgtgaggtggttttatatttcgccttttttaaaagcttgtcaaatttatttggcaggcgagatatgattgcatcttgattgtgccaatgatttcctgctttgaggccaaaacgcagtcgtcgttacaatcaatcaggtgcagaaaggactccagataagctgagctgccaacgcagccttgaagaatagggcgtgctcggcaagatggccgagccgaaatgatataggcagccacgttgtttttattaggttcttgtcatttctcagcggttttgaacggtctatacctggcctttttactaggttttccccttttcggataatctactgcttggttttttctaaacaaatcatatgggcccacgtggccagctttgggctgcggggagttggtgattgaaggcacggctgggagcatgcgttcgcggcggataggcaagcgggtgttgcgtgtttgcaatttcccgcccaaatggttgtctggcgtatgtttcgaggcgcaggtcaccggtgcttgcgacgcagcccgccatgccgctcctgcggagcttccattgccgcggccgaacggcagccgcctggtgtgagccgggcggcgagtgattttcagcgcggcgttatggtcgtgttgccagggttggcctatcccggcgatggtggcacgttgcggcgaatatgtcccaatggcgtgggcgaacccgccgggggcgggccgctccggccagcatgcagcagtcctgccagcggaaacaggatggtgccgactaggctgaggggagccgcgtttttggtggcgctttgctggcctggcggcgcggcgcgctgggcttgaagttgatcgtggctgtcggtcacctaggtccgatctgcggtcgctgataatcctggcgaagtccctttttagcggtttgatattttatggagaggggggcctagatctgcggatgggtgtttcggatgctgggagggtagaccgggcggcgcacgcatttgttgggtctggtcgcgcggccgcagccagtgcgtcctgattatttgcaaggggtcgccggtccggggagggtggcggcggcttgttgggtgtgagtggttttctgcgccgtttcgctggcttggccagcgggagtgttgcaattgatcttggattgcgcaagtcgggtttgcagcttgccgtcgcaggttgtcgtgaacgtccatgaagtgagattgccctgcttgccgacgcaattgtgacaatacttgatactactggatatcagcgtggagtttttcaggcactcctgagacttgatgtcgcccagccgccattccgcagcctggctggtggtggcaagagctagcaagctggcggccgcggcgatggcgcaggcgatggcattgttcatggcttgtatcctcatgggctggttaggggccgttgccacggcccataagcctgcagcatagcgagcctgcggatggcggatgccgtcctttggccgagttgctttttccggagccggcgcgctttgccgcggcaggccgccctaaagagagggcgcgccttgcgcggcgagatggtggcatgctttgccgtagcgcctttttcatccggatggcatggggggcgccatcttgaattaaccgaaaaccaggtcatgaaatgcattgcaaaaatcgccaaatggtatgagaacaaccgggttcgaatcagcggaagctgtgatgtcaaaaaccaccattaagcgtttccagggaattccgcaacgagcaagcaggccgctgttttcgtcatcctgtgctctggcaccgctcaagccgcgggctgcgtcgaattcgatggctcgaaccgcgatcaatgctcggtaggcaagcgggaggtgctgctgcagggggagtcccagattgaatggatggacttttatcgagaaaatcggaattttctgtagtgatgtccgcaattgagttctttctcgcgcggtcatatcaaaaacgccatgcgggccgcgtcaaactcgctgaggcgggtggcgtgcgaagctaggcagaggatccaaagcgccctggcatgccatcagcgatgcgctgccgcaatatgatgcgtttcctggagactgagtggcgccgtcatacagtgattatgcctgcctgatatgccgcgcggctgcggcatcgtcgaattcccagctaaggcggcaggcattctgatcttggtggatggctctctgatccgcgcattcagcaagggaatgatcggcctgctggcagccaacgggactctgccgtgcgcatcctggttcattgaaagctgagagccggccatatgtcctgcgccagcagagggcaagacgtatgactaatgatataatatgcttgcttttccattttttgtaattggcaataatgaaaaaaattcttccgctgctggcgttggccagcctatccgcgaactcccgcgctgatgataatgaagtgttgcgccatatcgccgactgttccgacagtttttcccgttatatggccagccagccgcaatcggctgccgacaagcatttttccgtgaagaacggcgcagccgctctcaagatgaaactggtaaccgatgccgccaaggaactggaagaaaacattccgggcagttcgaccggagtgaaggatatcagtcgttacgccgatatcgataaagccattccgatttctgggcaatgggcattgagcagctactttgaagagcatgcgcgttttgccaaaaactcagatgccggcgtgaaggaaacctataactgggtttttcatctggatggcaaaaaggatatgttgctgcgcgatttcctgcgcctgaccggcaatctatcgtatagctgtgatggcaataactgtctcgcttaccagcgcatggcgaaaggcggctggcaagcggtgaagccggaacagctgaaggcaggcgaaccctatctgcaaattatggctagcaaggagggcagcaagcaattcagcatatcttgcaatttggcttcggaaggcaagcatttgccggttggcctgatcaaaacccgccgcccggattggcaactgaatttctgatgcgccaaagagaacgagcaaagtcggcgcccaaaacacatatgcatgccatgccgagcgcaggtgaggcgagtgttgcaacagatgtcgaacgctgatttcgttctttatgctcgacaagcgggtcatgcctcaaagtggcatggcctgtttgcttttgggcggtggaattggaggagggcattgtcaatttcttcttgcgaggcggaaccctttgtgcgcagctgttggctcgaatagatagcgtaccgtttctttgacgcagggttcgatgaccagcacgtcgccgtcccagccgtacagcgtggcctggccctggctgatcttggcgatgcggcgtccctgcggggcgtagtggtagtcggtgcgctggccgtccggggcgatgaggcgggagaggtggttgtggctgtcccattccagcttggtgaggctgctgttgacgcgcttctccatgtcgtagcggtagtggcggccggcgtactggctcagcaggttgcctagcaggctgttgtcctgatggccgtcggcggcaggggcgttgtccagcaaattgcctgccgggtcgaaattgaagttctccacgcccttgggggtggcggcttgcagcaggcggccgaccggatcatagcggtaattcagttggccgttgcggctgtcggcgatgccggtcagttggccggcggcgtcgtactggtactgtcggctccactgcgtcgcgcccatcagtcgctggctgctcagccggccggccttgtcgtagacatagcgggtggcgctgccgtcgaagccggattcggcggtctggtggccgttgcggaacgggggctagctttttttgcaggcgagctgcaagctgttcgatcattccaaccagcatggtgcgatcttcgtccgccagtttggccagcagatcggttatatacatggcctgatctgttggacgatagctagcttcttgtaccaaatcggctgttgagcagccgaaaatttccgacagctgcatcatgcgcgtgatggttgggatgaccactccacgctccatcctagatgtccagtcccggacgattgctcacgcgctttttgaataaatcaggccgctgcttttgccaagcctggatcggtgtccgatgctgtagtgccaattgcggcaaatgctgattgtagagcaggacataacgctgcagtgtctcgcccagatctttgccggattcgcagcggtgcgtcgccagcacatcgctgatccggccattgaagcgctcaaccatcccgtttgtctgcggactgcgcggcttggtcaaccggtgttcgataccgagtgcgtagcacagcagatcgaactcatggtctgtcccactccccatggacagagggttaagcactaagctctgaacggcggcgttcgaattcaaccggggtcagataccccagggttgaatgacgtcgttggtgattgtaaaagcggatgtaatcaaacacatccgtacgcgcctcatcgtagctccggtagtgggtcagataaacacgttccgacttcaatgaacggaagaagctctccatcgctgcattatcccagcagttcccggtgcgggagtggctcggtaccattccgtgccgtttcagcaatgcctggtagtcaaaggcacagtactgactcccgcggtccgaatgcagaatcacctctcctgaaggctggcggcgcgccactgccatcgtcagggcagcatgcaccagttcttgctgcattcgatgatgcatggcccagcccactatcgcccgggagtacaagtcgagcaccaccgccaagtacagccacccttcaccggtccggatataggtcatatccgacacccaacgctgattgatgtcgccaccagcagcaaattgtcgctgcagcagattaggcgccatgggtagaaggtgttgaccaccactgacgggtcgacaatgtttacgcgttctaaccctgataccgtttcgccgcatcaggcccgcgatgcgatgccgcccgcaggcgaagccctgtgcaagaagttcggcatgaatacgccgatggccataaataccattgacctcggcatgcaccagccggatttcacgtagtagttgtcggttcgccatctctcgcgccgaaggtgggcggtgtagccacgcatagtagccactgcgggacacacgaaacagttggcacatcggggctaccgggtagcggtccgacagcgcctgaatcgcgcggaatttcacttcgtgggttgcgagaagatggcgagcgccttttttaggacatcgcgctccatggtaacgcgggccagttcatcccgcagtcgcttgagctcggcggcttcaccggtctgtttgcctcggccagggaaggcatcgggtcctgcgtcttggagttgacgcttccacttgcccagcagcgactcggtaatgtcaaaggcttgggcaacatgccgtaacggggtgccggcaagcacctgctcaaccgcttcgcgcttgagggcctccgggaaagtacgtctggtcttggtcatgaacactgctccttggtggggattatccaccttaagttagtgtccacggggaatgggacagaccagttagtcgggcgtacagggcccgctcagcgcttatttttggggcctgaagcttttgctatcaggcgctgggcgaaggtgcggcttgtccgtcactagtgactgtgtgcaatcgtcaccagtcgatgaggaagggaagcctttgcaaatcaaaaatgtcactacgtcaccatcgtcaccatgcgatttctgcggggaggctgctgcggtcttgagggcgttgctctcaaggctccagggcctacatctggttgttggcattcatgcatttttccaaccagagtatggattgcaaaaggtgctagggacgttgtgtatagattttatcgatggtttggcgcatgtgcacaaatctatacacaaaaaatgtagatgttactggatggtcttggatggctctggacgtaaaaaaacccgcaaagccttatttggcgcgggtttgtggactttcttggactgctttggaagtgtgggtggtgcccccgacaggaatcgaacctgtaactgccccttaggagggggccgttatatccatttaactacggagacacgacggaaaactgtggtcaggcgctgcggtccaccgacaggcgggccagctcggtcagagcttggcgggtttccgtatcggggatggcttgcaaggcggcgatggccttttcggccattttggtggcttcgttcttggcgtagtccagcgcgccgcaggattgtaccgcagcgagcacatcctggaaaccgtcgcggctggcattntctgacgacggcagccaaaagcaaacccaatgctcccagcgctgaaacggctaccgcggctccggccagcaaaccgaaaccccatttcgcggtagcaggatgctctttgacccaatctcccatcttttccgatttgccctgcagcacctggccaaagggctctccccactccttgatggaggggccggccaataacgacagtgtcgtactgatggactcattcaacgacttccacaaattcagggtttccttctggatgacactgaggcggtcctgtagcaaggcttgcttatcaagcttgtccagagaggcttggtagcctgcaaccccagcggttgctatagcttcagcggccttagctccttgcctaccaaatagaacctgcagcacctcatttctctccgacctcttcacttcgcctaacccaccaatctgctttgccaaattatcaaccccaagaaaaccacctgcctcattgaaaaattttaatttaattccatagcttgccaattttaaattagcccgacgtattgcattaccattactgggcaatagagtatctttccgcccctccacctctgccaatagattgatgaattcatcactacgtccacccacataccctccaatactattccccaatgccaaaacgctcttcaaatcattgatgccattcacacccaaaccatccctaacattgtttgggagagaaaggattcgctctaattcagcaggtttcttattaaaagcaaaactggcctgttgaagaatgttagctccacttggcaaatcatccatcaacaaaccataaacctccttcaaaatggacaccagcttggccgcctcttgcggcggctcgcgcaataccgcgccaagcttggcgctagcctccaaaccgccagccacgacttcctgataaaccataccctgatcaatcaaagctttgccggccagcagcatgtccacctcgccccccggcagggcgcgtcccaatgccacagccttgtcgcgaatcagcgccaagccctctccaaccttgccgctgcgatccagcagcgacaagatcaagcttgccagcgcgctatccatgcgggtgaaagctgtcgcaggttgctctgccagaccaagcatcctccccccgagtgactggaacgatccatgcaagccaagcagcttgccggaaaccgactcaatcgcatcgccgatgtgattgaacgccctcgtagcccgctgcccctgcaataccgccgcattgccgatatccagcaatacaccgctagccaagtcgcgagcggcaacctgaatttcaagttttaccggactatccatctcttaccttcgcatcagttggttgacagaattcacgtagccaatccgagatccggaagggctaacgctcctgccatgatgtctgttcgatagacacaaatcgagaaagaagacattcagtagatcagccataccacatgccaaactgtactttaggccggcatatcacagaaaaagccatacatccgggtgtgatgtatcatccaaaaatgaaaaactagcttctagggcataacccttcatcctatgcctaaaaaaccaaaaccattttcgccaggagtaaaacgtgtccatcttctcaaaacttattttctttacttgcttgaccgccatatcaccattcgctttggcatcaccattcatttccggtggactcggaatgccttaccatgaactgatatcaaagtatggcccgaaagaaacatactgcccatcatccagcccatactataactacccatgcttacaatctggattaatactactaaccgatgaaaccaacaagggaaacactgaagaaataggcattttctggccaactgagatcaacactgaccacgccagaatactagtcacaagctatttcccaaaagactggaaaatagttagaacatacaaaataaaatactcaggaagagtagtcgacttatactacagcccatccctagccaaacggtttggaaaaaacaaatggaatggagaaaagcctggaactttcactgcagctcactccccagataaacgcttcgttctcatctccatcggcaacaacccatgactcaatgcaaaagccgccgcaaatcgcggcggctttcattgccccataaaactgccttaaccgtacgcttcttgttcggtccgaatttgctcagtcgcccgttcgcaccatgccaggaaatccgccacctccaggccatctatttccgacggctggaaatgaaaccacttggcaagcaatgccgctccggcccataactcagccgttgtcacccagcatccggcgaaaagactcctgcaccttgcgccaatcgccaagatccaggttctcgatgtcctccgcggccaaaccggacaataaagccgccaaaccgatttcctgctcttcctggcgttcgccaaaacgcgccgccagtttgacgtccttcacttttggacgacgcagcgtcagttgcgagacgcgggagccgttgccaagcatcaggggcgccagcagttctaccgtgatgctctcgatcaggctgccagctggttgcggctgaatggtttcgctcatgggtcaggctccgatatggctgcggtaattggccagcatgtcctctccgccgacgcggaagatattcgacatcacatccagttccaccacatcctggccagccagggtctgcttgatataggtggcggtgaatttgctggggaagtcgacttgctcgtgctgcttgaacgagcctaacggaaactcctggaacgacaccgtcagcaaagtcaccagctcgcgctcctggctcaaaccctgggcattccagctttccacgttggagcggcacatcagttgcaacgcgcgcaaagggttggccactgcgcggaaggcatccaggtagaacgagctccacttgatgtcgccctccagcgcctcgaaccccgccggcaacttgagcttgccgaacatgcccagcgccttgtggtccttcatcaccgccttgagcaccggcagcttgatctcttcggcgcaacccagcaggttgttgccgcccaggtagatattggcattgacgatattgttgacttgcacggccatggttatcgctcccctttcagattcagcaggtactcgtcggaaatctcggcctcaaggctcagtctttccatgggcggcggcggagtgaatttgtactgcagcagcagatggccggcagccagctcttccttgacgttgcgcgcgggatcgaaccagcaatgtccgccgagaatggcgccgtcgccgatcagtttgcggaaaaaagcgttgatgctgccaaccaggctgtcgatcaacggctggtccagcgggcgatccatgtattgcttgctgaaatagcgcagactctcgttgatgatgtcggcggtacggcgcaccggaatgaaattcctgatatgcgacaacaccggccaggcggcggagcgattgccccaaacctcccagccgctgccgaaggcattgaacaccgtgacgatgccggcttcgttgagcaggttcacttcggcattggcatcatccagcaatgccgtcagcggcctttcgatgccgatcacgccctggattccggtgttggatggcgaccaccaatagcctttgtccaggtccttgcgcgcgatcacgccggccaagcgctggctgaacggctccagccgcggcgcgttggtttggtcatcccacaccttcagatgcgggtagcacaggatggcgcgctcgctgccgacgttgaagttgatcgcgccacccggcccccgcccttgcagcgcctgctgcaccgaaacgccgataggcgcgtcgatcagcgcgaaagcgccagtctgctcggccacggccaccatttccgccgccacagaagcctgggtgcaataggccggcgcgatcaccagcttggccaggaagccgaacgcgctgaatgcgtccttggcagccttcaagcccgtgcggcggccggcggcatccacgccgccgatgatgtcggccgcggtcaccttggcgggatcggcatagctgtaattcgcccgcacggtggccaggctggcgatcgcgccggctttcaaacgcgacagctccccgctatcggcatccagttggtagtcgactccggctacgtagttcctgccgccatccaggcttttcaattccaggcccatcaccgcgggatgacgcaagcgcgcgcggcccgagctatcgaagctgacgttctcgttttccaccgcgctcttgtggagagaggagtccagcacgttcaacaccagaaccgtgcctgcgccttgatcgtaaatggcagccagcgcctgcgggatggtgaagccggcatggccacgtccaaacgccgcggcatctcgctccgacaggcacaaagtcaactcgcccggcttgcccttgggagccgtgcccaccagcaagatggtggcggatttcaccacccgtaccggccgcgcgcccttttccacttcgatggtttccactccgtgcagaaaattagccggcatgagtctctccttggttgagctggcggtctgctggctgcaaatagcgctgagccaacagcgcgcgggtatattcgccgtcctcgggcaaatcagcctcttgcccgcaaaacagcatcacttcgcggccatcggccagcgtaacgccggacggcgggccatcgtagcggtagatcatcaagcaccctcctcgtggttgactacggtgagcgacggcgcggcctccccatccagctgcgccaccgccaatacacggcaagccagatgcaccttgcagcgccagccatcctggccctgctgaatccggctatcccgtacacgccgacaaggctctgcgcctaccggccgaaacccaagcaagcagcgatataccgccgccagttgtgcatacagtcccttgtctgtgcgcaattcgcttgcgctcaactgcagttcaaagcgcaaagtgcgccattgcgctgtcccctgcctccgccccaagcgggaaccgcggtatgccagccatgccgccgtttctcgccgtgtcggcggacccggcaacactggcatgtccaagagctgcaaagccgctcccagccgctggatgcaggcgtcttctatcgcagtgaccatgtccatagtgaatcccgagtaaaaatgaaaaccctaccaagctcgcttgagcatctccgccgcgatagcagtcaacaccgcgaccacgcagccgctgatggcgccgacgcgcgctgcttgttgctccacttggcgcagccgagcgtccaagccatccagccgctcgctctgtcccacttggctggccgctatcatgtccagcttgccctcgatccggccaagcgcgcgggtcaactccccaccgctttccagcatcagcaccaacctttttcatggcttttctggcaaatcaggcaacgccggcagccgggaactgcgcggcggcgcgatgcaggaatatcatcgccgcactcctggcaatggctataactggccgcgccggccaggttcatgcgcaccgcctgccgcgccaaagcctcctcccgctggcgctgttccaatgcctgggcttgatcgaatagatcagtcatggcggtgcctcccgccatcgtcctctgcggaaaggcctccggctcggctccggcgggagtcaatcagcctcaaggccgcggaatacccgcccaccaagcccagatagagcagccactgctcagggccgagcatgtcgcgcccgccctggtacaaaaacatggcggtggcggtcgcgcatgccacattggcccacagcttggcatgcgacagacgtcggctgcgggggtggcagatcagatcggaaattcgcattacgattctccttcgggtcattcgagacaaaccgcaagcaggaaacaggcatcgcgcatcgatgcggccggacggataacaaatcgccagccaggcgtgcaaattcattgcatgccccggcggagcatcgttcacgcgctgcctgtcattcagaaaagattgccgcgagtttggcgctgcggtttgcggccgattcggaaacagcggcactctgcatgctggaatgccctgattgtgcccaacgcaagaagagcgctggagcgggaaggtcttcagtggcggcggggatcggtagccgccgggtcactgcaatcggtgcgcttcaaaatgtcccaaatgcggcggtctgtcagccgatgctgctgggccagctggctgaccgcggcattgctgcccaactcgcggctgagccgatcaaaagcctcgcaaatggcgtaatcacgcaatcgacgcaaggcgctagcgcagcgcggaatgtaaagcaggtctccaccgtaatgctggcaaagccgatctgccgcctccactcccaccacttctgccagagccaggtaacgagcctcccccagcctgctgcgcttcttgctgacgggaaaggtggtacctcccaagttctccaccagtttcaacgtattaggcagtcctatcatgccggcaatcaggcgtacggtttccggcaacaagtttggcaactgttccagcttcatcgtcttgttctcctggtatgtgcgaaagtgcggcagcttaatattcggtccagaccaccagacagccgttgattctgaatcggccagccttcgggctgctatagaagtcgtcatgggcagcatcgccttggcccgccatccgccggcaatctggatgcggctctatgcgtatcgtcggttgccgcggctcaagcaactccacccacatcacggtgaaaccgagccgggtcaatctctccaccgcggcagccactctgtgggccgaggcgacgatggccgcattgcgtagcggccgcaatggactgttcgcgtctatcatttttttctcccccaaatcatccacaaggttcatggcgcgctggcgttccactcccgcgcagccagcggagtcaaaccgttcagccaccggcaaccggatggtttgccaccccaaagatcggagccgcggcaaccaagatatccatcacgccacaatgtctccaaagtggaaaactttcctccttcccagaactgtttttgagaaaacaaacatggcactttccactttatccgcttagaattccatgcaggggttcgtctgactaccctgagaaaagatttcagacacagcccaggcttacctgacaaagcaggccatggtttagtgaaagtcttttcatggcactgatggcaaaagcataagcgccaacaaagtgcaaagtcaactcgggaaaacttttcacttatgccatgtgacgcccacgcaacagcctgaaatttcggaaaaatactgaagtccatcagaaaagtggaaggtttcaataaatctccactgattcaagaaggaagcgaaaagtgggaccattactatccgccagtgaaatcgccgcgctcaaattgccaggtctgcccggcagcaaagtcgccatcgccgctcgggcggaacgagaagggtggtatggcgaggaaagaacgggactggggggcacccgcagggtgtatcgcctgcccgagcactatttggtcaaggcagacgcggggaccacccgagcagatgaccagacctcgtcgtattcggtcggcggcgccccagccaaacggagcgttgcgatcagccctccccaaattgacttggagacgctgcagatggtggaaactgtgctggatcaggttttacaggagcgcaacctcagactgaagtcggaaaagcgcggcgccgtggtcgcgtttctatatgactacgccagcaaaggcggcggacgggatggcatgttgatggcgctgcaagcgctggtggcatagcactgggctacttggccaagtggccatgtatcttgcagggaacggctgggataacatcaagacttttcgcatgcatatcagtcatcctctgaatgcaagacgagacccaacaggccttgagggaactgctggccggggcacttgagccctccccttcacgtggcggccagcccctctcgcccggccatccgcgggtctcgcatcccgctccggacgccgccaacgatgcgcgctatgacgacgggccggctccagcaacgatggcgggcggcaacaaaaatggcgcaaccctgttcaaggttgcgccattcttcatcgcgttcatccatttctttctggacgatgccggccagtggctggccgcctgggtattggcctatctcgcccatgcgcggccgggccgcgccgtggtcaaacccgctgcgcggcctgcaattcgtccagataaggcctgattttggccgcggccactttttgcagcttgcacagcatgccgtggttcacatcgcccaggcggaactggccgcgcagggtgtcttccaggtggcacagcaggttggcggccatttcggcatcagccagcgcgcggtgggcgcggccggtgtccggcaggctggcccagcgggtgagcgtgcccagcttgtggttgggcgcctgcggcagcagccggcgcgacagcagcagcgtgcaggcgaaatcctgcccgcgcgccaggcccagctgcgccagttcgtaatcccaaaacttgcggtcgaagctggcgttgtgcgccgccagcggagcggagccgacaaaggcggcggcgtcgcgcatcaccgcgtgggccggcggcgcggcgcgcagcatggcgttgctgatgccggttagcgcctctatcatcggcggcacccgcacgccggcgttcatcaggctttgaaaacggtccaccacccggccgttttccaccatcgccacgccgatttcggtggcgcggcaatccggccccggcgtgatgccggtggtttcaaagtcgatgacggcgacgcgctgtctcacgccaaggccgccttggcggcctcttccggcgtcaggccgtcaaaaaactggtcggtataccattcggcctgctcttcgatatgctcctgagcctcggcttcggtggcgccggccgccaccagatgggtttccacctcggcgcaccaggccagcaacgccagggtttcctcatccagtttttcttgcggctttttcgacatcgggttttccttgcaattcagtacattatcgagcccggcattgtacccggctttggccggcatgcaagcgccaaaacgcgcttgccgcgccgtcagtcgtccacccggccgcgcagcgacttgatggcgccgcgctgcgacttgccggccagccgccgctgctgagaaccataagtgggcttggtggcgcggcgcgccttgggggtgtggctggcgctgtccaccagcgcctgcagccgtagcagcgcgtcggcgcggttttgttcctgggtgcggtactgctgcgccttgatcaccagcacgccctccttgctgatgcgcgtgtcgttcaggcccagcaatctttcgcgcagccactccggcagcgacgacgcggcaatgtcgaaacgcaggtggatggcggacgaaaccttgttgacgttctggccgcccgcgccctgggcgcgcatcgcggtgaacgccacctcatcctctttgacgagatagcgggaaacagacatggagaagaaaacggtttcttaaaaccgcattataagccgcgcgggccgccaggtccgcgcggcttgccgcttacgcgcccaaacggatgcgccgtcgcagatcagcacctggctggcgacgaagctgctgccgatcaaaaacgccaccgcgtcggcgatatcctcccctccacgaagcgcttcccgcccgcgcgggcgctgacatgactggcagcgagcccgcgcccatccatctatcattaacgcgccggcgcttttattttgatgctccttgccatagctaaaggattcttgcttagctcaaaaaacatgttcccacttctgaccggagaacctgatgcgacaactgaccattcgccaactcatgtccataggcaccgccatcgccgtcatccccttgctgttcggcaacctgctgatatggcaggggaatgcctcgctgagacaggccgccacggcaagcggcaatgcgtcggccgccctgctgcatttcaaaaacgcccgctacaacgtggtgcagattcagcagttcttgaccgatgccgccgccaccggcgaaaccgccgacgactaccgagacgaggaaagcaactggaaacaagccctgaccgagctggataccctgtcgcaacttctgccggaactggccgccgacctgcagacgctgaaaccgcaagtcaaccacctgcacgaagaaggacgcgcgatggtggaggcctatatccggcagggccgcgaggccggcaacgccatcatgaaaaaacccggctccggctttgacgacaccactgacgcgatagacaagaaacttgaagaactgtccaagcgcatcgaacaactattcagcgcggcgaacaacgcacaggaaagcgccctgcggcaaaccgcgctgctgaacgccgccatcgcggcattggccattctgctcatactggccgccaacagctatcaatacctcagtctgcggcgcttgctgggcggcgagccggcttacgcttccgaagtggcaaaggaaatagccgacggcaacctgtccttgcaggtcgctaaccagtcgcagtcgacggacagcctgctgggctcgatgaaaacgatgacgcagaaattgacggagcacctgcggctgctggatcaggaaaccaagcaggtcggccagtcctcgtaccagatttccgaaatttccaaacacatcaccgacaactcggaacgggagcagggccactcggatgaggtgcgccaggccaccactgtgctcgaggaaaccacggaatcggtgcgcgccatcgcgcagaaagtcagccaacacgcagaccaggctcgcctcagcgccaaccagggcatggccaccatgcgcagcaatatcgaggagatgggacgcgccgtagacgaggcgcagcaggcagagggcaaaatccaggccttgagcgaggccaatcagaaaatccaggtcatcacccagaccatatccagcatcaccgagcaaaccaatctgctggcgctgaacgccgcgatagaagccgccagggcgggcgaagccggacgcggcttcgccgtggtggccgacgaggtgcgcaagctggcccaccatgccggccaggctaccgatgaaatcaccgccatcatcggcaatctgaaccagctgatagaggaaaacactcagtcggtgcagggcatcatcgagcggacccgcgccggcatgcaaaaagccgaagaagccagcaccgccatctccagcctggtgcacgacatcgacaacaatgtccatgccgcccatcagatcagcgacgccagctccacccagatgcagcgcctggacactttgcgctctacgctggccaagctgctggacaatatgtccggcaacgcgctgaaagtgcggaccaccggcgtcatcagccgcgacttgtaccgggtgacgggcaatctgagccagatcatggagaaattccgcttcgaccccaactggacgccgactgcgcgcagcaacgaacaccgccgccatccccgcgtcaacaagaacctgctggtgcaggtggacgacggcggccagaagcgcgacgccaccaccgtggacttcagcctgaccggcttgcagctgcggctgccgatgccgctgcaggccaaggccgggagcgaactgccgctcagcatccagctgccgcaagactccatcgaacgctattccaagcagcaaccactgacgctcacggccaagttgctatggacacgcaaaaccgaggaaggcgagttgtacggcttctcgttcggccgcccgaacccgcagcaactggcgcaactggaacaagccttcctattcttctgccacaacccgatctacgaataagcgcgcccgcccgcaaatgacaacccccgccgcaggcctggcctgggcggggcgggggtttgcgatgcgcgccagcgccggatcaagacttcaggtttttcaccaggccatcgcacaccggcttttgcgcgtcgccggccggcagcttttcgcacacgccgttcagctggccggccaggcggccgatttcgtccgcgtgcttctggtcctggttccaggccttcaggcggctggcgatcttttccagcgaacggcggctgcgctcgtagaaggcgctgctggagcggcccgcgtcggagaagacctcgctggcggccttttcgatgcgatcggcgtcctgcggcgccagttccaccgcgttgctgacatagctggcgccccactgcaggcgggtggcctgcccttccgacgcctggtaggccttttcataccaggccagcgccgcggccttgtcgccgcgctccttggcgttggaggccagaataagcatgtggtagtacggcgcgtgcgaggttttcaattccgcctgcagcaacttgtccgattcgtccagcaggccggcatcggccagcaattcgccggcggcggtgatgaccgcctggcgctggtagggattggcgctcgccttgtccgcggcggccacctggctgcgcacgtccgccagcagcgacgccggcagaggctgcttggggtgttgctgcttgaactgcgacagcaaggcggaagtggcgcccaggcggtcgccccaagacagcgtggcgtccgcctccagcgccgccagctgccggccccaggcctgctgcagcgcctgcttgccggccgcgtcgtcgcccaagagcttgatcacatcgctggcggcgtaaatcacgatgtcggcgttggcgcggctaagcttgccgtcggccagcacctgcagcagctgcgcgcgcgcgtcttcgtggtcgaacggcggcggctccttttcgcccgccagcgccgccagcgccttcagccgcaaacgggtggcggtggcggtctgcgccgccggcacccgttgcgccagctgcgccagcgtggcggtgacgtccttctccggaatgatctggccctggtcaacatcccaggcgtagtcggccagcagttgccaatcttccgccgccagcggcttgccggccagcgcgtccgccagcagcgccttcaccggctttaccgtcaccaggcccagctgtagcgtgcgcaggtagcgctcgggatccacctcgcccggcaggcgggtgatttcggtgccgtcgggacggaacaagatcatggtcgggtagccgcgcaccttgaactgctcgcccagttgctgggcgttggcgctgtcgccgtccagatacaccggcacgaactggcgggtggcggcgatgaagtcgggccggttgaagatggtggatttcacctggttgcacggcgggcaccacaccgcgccccagtacaggaacaccggcttgttttcgctgcgcgccttggcgaaagccgccggcacgtcgccctgctgccagctgatgccgggcggcagcgcgtggccgtcggcgacatcggcatgggagagcggggccaggccggccagcaccagggacaacgccagtaaagtacgcttcatgatccagcctcgttcaaaatgggtaatggcccatgctaaaccaattactcacaaagcatatagcataactggcgatttgcttagcaagcccgctgcaaatccctgatgcctagccggccccaagcgcgaaatgacattgacctacccgcggcgagcgaggaaaaatggggctcgtcattccgccggaaaacccagccatgcccgtgaagaaccgcaaacatcgaatcttgcttttgtcgtcgctgctggccctctgcttgatcggccagatcctctcttaccgcaccgtcaacctctccagcctatgcgccggcgcgatcatcggcatcctcatcgcccagctatcggcggaacttgatgccctgcgcgccgtttaggcttcgcgcagttcgaaatcgtggctgatgtcggcggtcttgcccaacatgatggaggcggaacagtatttctccgccgacaatttaatcgcccgctccaccacgtccggcttcagttccttgccggtcaccacgaaatggaaatggatcttggtgaacaccttgggctcggcgccggcgcgctcggcctccatctccacccagcaatccgtcacctgctggcgcgactttttcagaatggtgatcacgtcatagctggtgcagccagcggttcccaatagcagcagctccatcggccgcggccccagattacggccgccgccctccggcgcgccgtccatcaccaccgcgtggccgctgccgctctcgcccatgaagcacacgccgtccacccatttcagcctcgcctgcatcgcttatcccctgctttttcaatgaaaatggccatcagactatcattgccgatttgggacgacaaagaatcacctgtagaatggaaagattgtcccgttatatctgagctgcaccatgctggtacttggtattgaatcttcctgcgacgaaaccggcgtcgccctctacgacaccgaacagggcttgctggcgcatcaactgcacacgcagatggcgatgcatgccgaatacggcggcgtggtgcccgaactggccagccgcgaccacatccgccgcgccattccgctgaccgaagcctgcttgcaggacgccggcaagcagctggccgacctggacgccatcgcctacacccaaggcccgggcctgggcggcgcgctgctggtgggcgccagcatggccaacgcgctggccttcggcctgaacatcccggtgattccggtccaccacctcgaaggccatttgctgtcgccattgctggccgaccccaaaccgcagtttccatttctggcgctgctggtatccggcggccacacccagctgatggcggtgcgcggcgtaggtaattacgaaatcctgggcgaaacggtggacgacgccgccggcgaagccttcgacaaaaccgccaagctgctgggcctgccctaccccggcggcccgctgctgtccaaactggccgaatccggcaaccccggccgcttcacgctgccgcgcccgatgctgcactccggcaacctggacatgagcttctccggcctgaaaaccgcggtgctgacgctgacgaagcaagtggaggccgagcacggcgcaatcgacgaacaagcgcggatggacatctgccgcgccttccaggaggccatcgtcgaagtgctggtgaaaaaatcgctggctgcgatgaagcaggccggcatgaagcggctggtagtggccggcggcgtcggcgccaacaagcagctgcgcgcggcgctggacgacgccgcggcgcggcgcaaattcgaggtgttctacccgccgctggcgctgtgcaccgacaacggcgcgatgatcgccttcgccggcgcgatgcggctgaaattcgccgaaccggccggcggctacagcatcaagccgcgctgggacctctccagcctgccggcggtataaacccacccatttagccgcgccgccgcccagcgccggcgcggccaagcaaaacgccatgatccaactgaaaaacctcaacctgcgccgcggcctgaaagaactgctggtcggcgccaatttgacgctcaaccccggctacaaggctggcctcaccggcgccaacggcgtcggcaaatccagcctgttcgccatgctgctgggcgaattgcacgccgacggcggcgacgcgctgatcccgcccaactggaccctggcccacgtggcgcaggaaaccccggcgctggagcgcagcgcgctcgattacgtgctggatggcgacaaggagctgcgttcgctggaagcccagctggccatcgcggaaggcaagcacgacggcaacgccatcggccacctgcacggcgagctggccaatatcgacgcctactccgcgcccgcgcgcgccagcaagctgctgaccggcctgggcttcgacgaagccggccagcagcgcccggtggccagcttctccggcggctggcgcatgcggctgaacctggcgcaagcgctgatgtgccgctccgacctgctactgctggacgagccgaccaaccacctggacctggaaacggtgctgtggctggaagattggctgaagagctaccccggcaccctgctgatgatctcgcacgaccgcgacttcctcgacagcgtctgcagccacatcgtggaagtggccaaccagagcctgaccctgtacaccggcaactacagccagtacgaaaccatgcgcgcggaaaaactggcgcgccagcagggcgaatacgaaaagcagcagcgccagatcgcccatctggaatcgttcatcaaccgcttcaaggccaaagccagcaaggccacccaggcgcaaagccggatcaaggcgctggaaaagctggagcgcatcgcgccggcgcacgtgtcctcgccgttcgacttccatttcgacagcccggacaacctgcccaacccgctgctgaagctggaaaaggccaacgccggctatggcgacaagatcatcctgtcccagatcagcctgtcggtggagtccggcgcgcgcatcggcctgttgggcgtcaacggcgccggcaagtccacgctggtgaagctgctgtccggcgacctggacccgctgtccggcgaacgcgtcaacgcgcaaacgctgaagataggctacttcgcccagcacacgctggaaacgctgcggccggaggaatcgccgctgcagcacatgcagcgcctggcccccactgcgcgcgaactggagctgcgcagcttcctcggcggcttcaacttccgcggcgacaacgccaccgaccccaccggcccgatgtccggcggcgagaaggcgcggctggcgctggcgatgatcgtctggcaaaaacccaacctgctgctgctggacgagccgaccaaccaccttgacctagaaatgcgccacgcgctgacgctggcgctgcaggacttcagcggcgcgctgatcgtggtatcgcacgaccgcagcctgctggagtccaccaccgacgtgttctggctggtcagcggcggcaaggtgcagccgttcgacggcgatctggaagactaccgccagtggcgcatcgcccagctggccgaaggcagccagccctccagcggcgacgcgcaaggcgtcaaccgcaaggaacagaagcgccaggaagccgaagcgcgccagcaactggccaagcagcgcaagccgctgcaaaaccgcctgagcaagctggaacaggaaatgaacaagctgagcgaggaaaagtcgcagctggaagccttcctgtcgtccagcgaggcctacgacgacgccaaccgccaaaaactggccgacagcgtcaaacgccagggcgaagtggccggccggctggaaaccgtggaagaagaatggatggacgtgcaggaacagctggaggcgatggagtaagcgctcgcgcccgcttccaccccattgacgacacccctctcgcaggggtgtttttattttcgccgtacgcgacccgcattggcaagccgccggcaaaggctagacaggccgaaaaccgggcaaccgaaccgccgcgctctcgccgcagcccctctttgcaggatagccataagccgcggagctttcgctttccaacacaatccacatccaaatagaacaaagctgtggacaagcccgggatagcccggcttttatctttagattgaacaacttgccgaatcagattaaaaaacaggcaatatcgccgcttacccacaccgctccggaacaagcctggtgacagactgtggataaacccaacagcccattgaaataaaagcataaaatcagcatgttcattttttaagcagccaggccggcctggacggcaaacgaatatcgaacacccagcatgcccgcatctcggcctgcgcgacgatgcggcggcgggaagtcaggcgcatccaagctgcggcgcgccaaataaaaatgccatccgcttttgacagcggacggcattggccggacggcgcactgaaacgaatcaggcgaccgacggttctttcatcagcagggtgatcaggccggcgatcttgcgcttcagctcgcgcctatccaccaccatgtccaccgcgcccttttccagcaggaactcggcgcgctggaagccttccggcagcgtttcgcgcacggtctgctcgatcacgcgggcaccggcgaagccgatgcgcgccttgggttcggccagcaccacgtcgcccaggaaggcgaaagaggcggacaccccgcccatggtcgggtcggtcagcagcgagatgaacggcagcttgttctctgacagcagttgcagcgcggcgctggtcttggccatctgcatcagcgaattcaggccctcctgcatccgcgcgccgccggaggccgccacgcagatgaacggaaccttggcttccaccgcggcttgcacgccgcgcacgaagcgctcgcccaccaccgagcccatggagccgccgatgaagcggaattcaaacgcggccaccactgccggcagcgaatggatgctgccctgcatcaccaccagcgcgtcgtcttcgccggtgtcactcttggccgcggtaaggcggtcggggtacttcttgctgtccttgaacttgaggatgtccacagggcggacttcctcgcctatttcgcgccggccctcttcatccagcagcaggctcaggcgctgacgcgccgtcagcggatgatggtggctgcacttggggcagacctgcagattgctctccaggtcggtgtaatacaaaactgcttcacattccgggcacttgctccaaagcccctcgggtaccgccgaaggcttgtcagcgcggttttcgcgcttgatcttcggcggcaggagcttgttcaaccagctcatgctgactccttgaatcttgagtgtccgggacatatcccggccacaggaagacggaggcctcgcctccgtcagtgttctagcggatggcggccttcagttcggccaccagatgagttaactgctctctggcagtttcgggtgtcgccgcctcgatttcctgcaccagccggctgcccaccaccaccgcgtcggcggcggaggagatggccttggcggtcgcggcgtcgcgaatcccaaagcccacccctatcggcaacggcagttcttgtctgagggcagcaattttacgcgctacgtcatcaatgtccagatgtccggcgccggtcacccccttcagggacacataataaacgtatccgcgcgccagtttggcgatttccgccacacgcgccggcggcgtggtgggggcaatcagaaataccgtatccaggccggcggcgtccagcgccgcctgcaattctgccgcttcttccggcggacagtccaccgtcagcgcgccatccacccccgcttccttggcccggcgggcgaattcggcatagcccatcgcgcacagcgggttcaggtaacccatcagcaccaccggcgtgacggcgttggtgcggcggaactcggccaccatttccagcacgtggcgcaaacccaccttgtgcttgagcgcgcgctcggacgcgcgctggatcaccgggccatcggccatcgggtcggaaaacggcacgcccagctcgatgatgtcggcgccgccgtccaccagaccgtgcatcagcgataccgtcaaccccggatgcgggtcgccggcggtaataaacgggatcagcgcctttttgccggcaagatcggcgaaacacttggcaatacgtgacatacagcgcccccttacagcgtgatgccggacaggccggccacggtattgatgtccttgtcgccgcggccggacagattgaccaggatcaccttgtccttgctcatggtcggcgcggtcttggcggcccaggccagcgcgtggctggattccagcgcggggatgatgccttccagatggcagcagtcgtggaaagcctgcagcgcctcctcgtcgttgatcgccacgtattcggcgcggccgatgtccttcagatggctgtgctccgggccgacgcccgggtaatccagacccgccgacaccgaatgggtctccaccacctggccgtcttcgtcctgcatcaggtagcttttggcgccgtgcagcacgcccactttggcgcccgcggtgatcggcgcggcatggcggccgctatctatgccgtgcccgcccgcctccacgcccaccatgcgcacgccgggaacgtcgatatagggatggaacatgcctatggcgttggagccgccgccgacgcaggctaccacaaggtcgggctggcggccgatgatttccggcatctgcatcttggattcctcgccgatcaccgacacgaaatcgcgcaccagcatcgggtaaggatgcgggccggccgcggtgcccaggatgtagaaggtggagtcgacattggtcacccagtcgcgcatcgcttcgttcagcgcatccttcagcgtcttggagccggactccaccggcaccacggtggcgcccagcagcttcatccggaacacattgggcgactggcgcttcacgtcttccgcgcccatgtacaccacgcattccatgccgtagcgcgccgccacggtggcggtggccacgccgtgctggccggcgccggtttcggcgatcacgcgcttcttgcccatgcgtttggccagcagcgcctggccgatggcgttgttgatcttgtgcgcgccggtatggttgaggtcttcgcgcttcaggtagatctgcgcgccgcccagctgctcggaccagcgcttggcatggtagatcgggctggggcggccgacgtaatgcttcaattcgtgatggaattcctgccagaacgtcggatcggccttgactcgggcgtattccgccttcaattcgtccagcgccaccattaaggtttccgcgacatagacgccaccataaggaccgaaatggccctgcgcatccggaaaatcataccgatccatgtcttgctcctgatatgaatgccgccattctggccgcatctttgattcctttggacgcctccactccgctggagacatccaccgccgccggcttcacccggcgcacggcttccacaatattgctttcgtccaggccgccggacagtatcaacggcagcggcagcgcttccggcagcagggtccagtcaaaggtggccccggtgccgccgtgcgcgccctctacgaaggcgtcggtcaacaagccgcgcgcgtccggatagcggccggcccactccagcaagtccatgccgggccgtacccgcaccgccttcaggtaaggccggcggaaagagcggcagaactcggcctcttcctcgccatggaactgcagcacatccaccgcgcacgcggccagcacctgctccacccactcgcgcgccggattgacgaacaaggccaccacgctgacgaagggcggcagagcggcgatcaccgcccgcgcctgctccaggctgacattgcgcggactgggggggtaaaacaccaggccgacggcatccgcgcccagcgccgccgccgccgcgccatcttccgcccgggtgatgccgcatatcttgattctgaccatcgcgcgttacgcccttgttatgacgattgaatattaccgcaaagccaatcgttccgccgcaaactgcgaaggcaaggcgaacggttccggatagcccaccccggtcaggtacagcccgtccggcatgaaggtgggcggggcgctggtgcggtcgcaggccgccagcagcgccgacatgccgtcggcgtccatcgcgcccttgccgacatacaccagcgcgccgacgatattgcgcaccatatggtgcaggaaagcgtcggctttcaggtcgaagcgcagcaggccgccgttgtcgtggatatccagctgctgcaaatccttgaccggcgatttggcctggcactccgacgcgcggaagctggaaaaatcatggcggcccagcagcctgcccgccgcggcgcgcatcgcgtccacatccagcgcctgatggaaccagcctactttgccggccaacaggcaaggccgcaccgggctgctcagcaggaaatagctgtaactgcgggaaaaggccgaaaagcgggcatggaaggtttcatccacttcgcgcgcccacaccaccgcgatttccggcggcagcagcgcattgacgccgcgcacccaggcgttcagcggccgggcggcctcggtatcgaaatgcaccacctgcatcgccgcgtgcacgcccgcatcggtccggccggccgccacggtacttatcgcctgattgccggcgatctggctcaaagcctgattcagcctgtcctgcaccgtattgccatgcggctgggtctgccagccggcaaacgcccggccgtcgtattcaatgcccagcgcgattctcatgcccactctttcattccatcccggcaaccgccgcgccttgcgcgcggatgcgacaaaactgccactctaccctatccggcccggtttgcgccatgttccgggctgcgcaaaagcaaatggcatcgcctgaataagcgatgccatctgccgactttccccccgcatgcgcgcgtctagcggccttgctgcgcttcgcggatcaggatttcggcggtttccttgtcgcccatctccatataaagcttggccagctccagcttctccggatccggacgcggttcggcttcaagctcgggcgccgctggcgcgccccgcagcggcgcgggctcccgttcggcttcgatcatggtttcggcgacggcgggcgcggcagtcgggggcaaaggcgtgcgcgcctcctcaggcatggcgatttcggccgctgccgcggcggaggggaccacaggctccagtgcgcccaccgccggcatttccaccgactgcggcgcttgcgcggtttcaaacaagggatggcccggcatcgcggcgcggcccaattcgcacaccctcatccactgggtgctgtccttgccgaatatgtcgcgcgagcgcgccgcctcttcaagaaacgccgccttgtccggctgcgccgacagcacttccagcagcttatagcgcagatcctgccgcgccggctccttctccagcccttcgcgcaggatcagcaaaacctgatcatcacggccataagcgagatacacctcggcctcggccatcggatcgaccgaatccagatcgatgccgtcgccttttttcagcgtgctcatcagcgaggtcagcggccccagcgtcagcatagaggacggcacgtctttgccgccgccgtactcgtccgcggtctccgcctccgcttgcgccgcgcccgcccgctttctgcgcatcagcagcagcgccaccagcgccagcgccgcgccggcgccgcccaagcgcaattgcacatccctatcgcccagcaccgccagcgcatcgtccaccacgctgctggcggcggcatgcggcgccttggcctgctcccgcttggattcggctggcgacatggccggacgcggcgccgatgcggtcaccgcggtgacgaccaccgccggcttgggcttgtccatcccggccggcggctcgctccgggccgcggaggccggcggcgtctgaacggcagccggcggcggcacagccggtttggcctgagggggcatcggcggcgtcatggcggcggcggtcttgtccttgttttgctggatggtgcggatttgcgcttccagcgcgcgcgcgcgcgcctcggtctgcttcaacgcgcggtcctgcatcgccagcatgtcgcgcatccggcgttccgccgccagggcggccggcgacgacgcggccggtttgacggaggcgaccgatggcatcggcttatggtcttccgccttggccacgccggccggccggccgtcggccagcagtttcgccatgctgcccgatttggcttccgcgccggcggcgtcacccttctccgccgcatggcgggccggttcgccgcgcagcgtccattgcgccgggtaacgcaactcggccccggccaacaaacggttggcgtcgccgcggataaacgcgtccggattatctttcaacagcttgcccgccacgtcctcgccggcggcatggccgcgcatgcgcgcggcgatcgccgacaggctgtcgcccttgcgcacttggtagacgcgggtttccggcgcggcggcggatggcggcttggcgtggtcggcagcggaatcctgcgccgtcggcgcgccttccagcatcaacgcatagcgcttctccaccttgacgccggcggctctcacctccagccggaacgccagccgcggcgccgtgatgggcaagctggaagccaactgcagcacatgccgcccatcgctggagcgatccagcttgtgcgcgatggacgccacctgctgcagttgctccggcgccacctctccttgcgcgggatcggcgaaaatggccacctgcacctggtccgtcttatcgaatacgccgcccagcagccggagctccgcctgcaagggctcgcccaagcgcgagctgaccttgagttcgcccaaacccgcgccgtccagccgcgagccctggtctggcgaggcgacatggcgcttgccatcgtcgccgcttgccggcgcgggctccttgcggcgcggaccgtcgcgcttgtagtccacttcaaattcgcgcaccaaccgcccatccggccaacgcacctccaccgcgaaacgcagcaaaggctcgctgaagctggccggtcccttgaccgtcactttctggatatgcccgtcgctgccgcgaatcaatccgaactgcagcatcgaggccgacccgctgtaaggcgacaacagggcatagcgatttctatccgccaggtcggcctgggcgaagttttcaatttcctcgttcaccacgggaatttccgccgagaacgcctcgccgtcggcggaaagcacatgtatcggccccaatcccgcccggactgccgatacgcttcccaagcctgccaacagcaaggccaaactcgccatgcgaaaatttgcgaccatcgtggacgtccccaacctatttgcttacatgttttgccccaggcccggcggatatgcccgccatctcgatccgccctggccccatcttgaaatcaaaccatttcaagacggctgacaatgctgataattacctgcgattaaacctcaagccgctgccggctgacaacccgatgccggaccgatttccagcgatcatctttatataaaataggccggaaaccgcgcatagcaaattgtcccaaacccgattcgtcaaataaaacaaaatgctagccgattctttcacgtatcgaatccgccattgccccgcaggatcgcggcgccgcgtccgccgccatgaaaataatccggacaaacaaatggccgggcgtcgtttcggaaaacaaacgcccggccatcggaagaatccggcacaccggaaaatcagacgctgatcttgtccagcaacgctttcgcctcctccttcaacgcgccctgagcttcgctcaccaaatcctgcaatacctcgcgcgcgccttctctatcgcccatgtccagataaaccttggccagatccagtttggtcgacagcggatcgtccatcaccgacatgccctccgcctgggcgggaggctcttcggccgggggcgcttcggcggccggcgcttcggccagcatgtcctcgtacaacgactccagcccgcccccgccttccgcggccggcttggcttcctcaggcggcggcgcgtccagattgaaatcgaaatccaacaggctggcctcgcctgccggcgccggttcctcggcggcaacgggcgcggcttccgccggcagcatcgcttccaggtcgaaatccagcgtgccgccctggtcttcggcggcgggcgcttgtcccgccggcgtatcgaacaaggcggccagcggatccgcctcctccgccatcgccggcgcggactcggcggcgggcggcgcatccggcgcggcttcgccgaacagctcctgatccagatcgatgccgccgccaaggcccgcggacagatccagctccgcgtcgggcgccatctggtacagcggattgtccggatcgatcgcgcgccccagcgtaaccgtcctggcccacaacccgcccttgccatcgaaagcggcgttcatttccttggccaggcgctcgaaagcggctgtgtccggacgcgccgcgtacacctccatcagcttcatcctgacttcatggcgggacgggtccttttgcagcgcgtccttcaagatttcctcggcctgctggtcgcggccataggcgatataaacctcggcctcggccaccgggtcgacttcggccgcgtcgatcgcgcccgccgcctgggtgaagttgctcatgaaggaatggctgccgcccacggtgctgggaccatgcccggtgaccgtagagcgcgccagcgtggcgctggtagccgacaggctgcccgccgccgcgcgcctgcgcatgactaccgcgcccagcagtcccagcaaggcgaccacgcccaccccgccgccgatcaacggcagatgatccagcaacttgtcgagcagcgatttgtttggcggcggcatcggcggcgccgcgtgcgcaggggctggcttcttgagcggatggggcgccggttcaggcttgggcatcggcttaggcgcgcttgccgccggagccgccgccggaacgctggcgaccgccatgggcgccgacgccatgacaggcttggccggcagcggctggccgccccgcatcgccttcaactcctgttccagcgccgtgattctggccgacgcctcttgcaaggccttttcgcgggcgttgatctgctgctgcaggtcattcagccgcgcattgtcgctcccgtcgcccggcaccagcttgagcacgtcgccgcccttgccggccggcgccgccgactggccaccggccgaagccgcggccggggcggcatcgcccagaatgctggcgacctgggccgcgcccaacgccttcatcttgcgcgccgacggcactgtcagcgacgagcccggtttcggatgattgacatcgccttcggcgaaagcgtcggggttcgcctgcactagcgccgccatggtctgccgcaacgacgcgccccagggcttcaccctctgcgccagcgaacgcagggtcgcgcccggcctcactttcagcactgtgggttcgacgacgcgcggcttggccggggccgccgcctggtagcggccggcctggtcgctgtcggcgtagctggggacatcctggacgatgttcgggccgccgacattgtaattggccggatccagcaacaccgtgtattcgcgcaccgagcggccggacggcgccttggcctccaccacgaagcgcaggtaggggtcggtgatcggctggaccgagctgacgcggatcagcgcgccgcgcggattggggctgagcgcgaagcgcaattgggacagcgaggaggcgtaatcgacattcaacgcctggaaggtatcgatgctggccagccccaccctgacggcatccatttcgccaggctgcactccggtcatttcgatgtcggctttcagcaactcgccaagattggagcggacatggatcctgcccaatcccgcccaagccgcggcagagcatgccaagcctatcaacaggacgccaagtttgagttttacctgatttctcactgtctaccttccggcatggtctcgttttattttataggcacagacccgctggcgcgcgcatgggccattgctgcaatcttaggccctgcctgggcgtttagccagatttcatgcgggctgcaagccgggcggacccggctgcccgcttacatcagcgcgctctggccggccaggatttcggcgatgcgcacgcaatggatggccgcgcccgccttcacgttgtcggccgacagccacatgctcaccaccttgccgtgcgcgcgcaggcggctgacccagaccagctcgttgccggtggcttccatcggcgtcacgtagccgccatgctgatcgcggcccaccactttcaatcctgccgcctgcaggcgctttttcacttgctcgagatcaaactccttatgcagttcgacttgaaccgcccaggaatggccaaagaacaccggcacgcgcgcgcaggtcacctccagagattccggcgccagccccagcaggcgcgcggtctcgtcgcgcaccgagcgctcttcttccgaatcgccgttctcgtccagctcgccgatctgcggcagcacgttgaaagcgatgcgcttatcgtaggccttgacctcggcgtcgcggtgcgagaacaacgcggtggtctggtcggccatttcctccatcgccgcctggccgctgccggacaccgcctggtaggtggcgatgctggcgcgctggacgcccagcggcagcaaggctgccagcgccagcgccagcggcgtggtggtgcaattgggcacggccaccagcggtgcgcggcccaggtcctccagttcggcggcgttgatcgccggcgccaccagcggcacgccggcgtcggcgcggaaggcggaactgaagtccaccaccgcggcgccggcatcgcgcgcctgcggcgcgtattcgcgggaaacggcgctgccggcggcgaagatggccatgccgacattctcgaagttgaattcgtccaccatgtgcacgtccagctccaggttgccgaaggagacggtgctgccgtcctgctcggcgacatccaccgcgaacacgcgggcagccgggaagttgcgctcggccagcagttccagaatggcctggcccaccaggctggtggcgcccactacggcaagctgaagggatgtcgacatgattggtttcctattcattactgcgccggacggacaactccgccggcgaatccatgcgaaaagggcacctaagtgcccttatgttcttgagacggccggcaagcgccggcctcaggctgacgcctattctacccgtcagcgctcgatcaggatacgcagcatgcggcgcagcggttcggcggcgccccacagcagctgatcgccgacggtgaacgccgatagatactcgccgcccatcgccatcttgcgcaggcgtcccaccggggtgcgcagcgtgccggtgaccgcggccggggtcagatcgcgcatcgacgcctcgcgggtgttcggcaccacgcgggcccacggattggccgcggccagcatcgcctcgatctcgtccagcggcacgtcttgcttcaatttgatggtcaacgcctggctgtggcagcgcatcgcgcccacccgcacgcacaagccgtccaccggcaccggattcgcgccgcgccccaggatcttgttggtttccgcgccgcccttccattcttccttggactggccattgcccagatccttgtctatccacggaatcaggctgccggccagcggcacgccgaaattctggctggggaagccgtcgccgcgcaggaaatctgacaccttgcggtcgatgtccaggatggcggaggccgggtcggccagcagatcgcccacctggccatggatggcgcccatgccggtcagcagttcgcgcatgttcttggcgccggccccggaagccgcctggtaggtcatcgacgtggcccactccaccagatcattctggaacaagccgcccagcgccatcagcatcagcgaaacggtgcagttgccgccgatatagtctttcacgccgctggccaaaccctgctcaatcacgttctggttgaccggatcgagaatgatgatggcgttgtcctgcatgcgcagcgaggacgccgcgtctatccaatagcccttccagccggcttcgcgcagcttgccatagacttcggaggtgtagtcgccgccctggcaggtgacgatggcgtccatcgccttcaattcgtcgatattgccggcatccttcaaggccggcacctcgcgaccgatatccggcgctttgccccccacattggacgtggtgaagaacaccggttcatcgatggcggcgaagtcgttttcctcgcgcatgcgctgcatcagcaccgaaccgaccatgccgcgccaacctacaaagcctactctcactggaaatctcccgagtctgtcctaagtccgaatcgtggccgcgccgacggcacggttaattttttattacctcattgtgcagcgcgcaatcgtgccaggcaatggggtaaatcgtttttattgagaatgtaatgagaagaacagatttgaatgacatcaacactgaccggacgactcgcgttcgccattcttacaggctcgcccagccccgaaacgcggcagcccgagtggagccggccaccgcgcagactgacagcataagaaagttgactatgtaaatgactgtttcataactcattgcaagcgcgcatatgccgaataattcatcgcctcgggcgcgccgcagcagtccctcgccatcgcgacatgtcatcggagaagcacggcaatgtctgactacgatctgatcatcatcggcgggggcctgatcgggctatccaccgcctacaacgccgtcagcccctatggcggccatccggttctgcaaggcaacaaggtgctggtgctggagcaaagcaccttcttcaaccagttctgcagttcggccggcgcatcgcgccaattccgcttccaatacagcgaaacgtacatgacccagctggtgatggctgcggttccggagtgggagctgccgcaaagccagactgtcacccagccgattccttgcgtcggcagcctgtggtttggcgacccgaacacccccaccaccgaaggcggcatcgccccggcgatcgaaaccatgcaggccatgggagtgcccttccagtcgctgacccgcgcggaggtggaagagtggtacggcttccgcgacctgcccgccaactacagcggttttttccagagagacggcggcgtcatcaatctgccggccacgctgcgggcgatgtacaacctggcgcatgaccagggggtgcagctgaaggaagaacagaaagtcatcgatatcgaatccagcggcgggcagatcaccgtcaccaccgatgccggcgcgtatcgcggcaaaaaactggtcatcaccgccggagccttcaccaacgaagtgatcgcgccgctgggcatccagctgaatctgaccatctggaacatggtatccgcctatttccgcaagacgcgggccgacatcgactaccccacctggttcgccttccagcaacccacagccgccaacgccaatctgtactacggctttccggaaacctcctggtcgcatcccggctatatccgggtggcgccggactacccgtaccagatcatcagcgatccaagggaacgccgccctcccacgccgcaagactacgccggcacttgcgaatgggtggcccagcacatgagcggtctgtcgccggagccggaatacgcatcggcctgcatggtggcgctcgccgacgacggcaaggaattcattctggacaccctgcccggccaccccaacatcgtgctctacaccgcgggctgggccgcgaaactggtgccgctgctgggcaagatctgcgtgcagctggcgatcaacggcgccaccgactacgacatcagtccgttcagcatcggccgtcccggccttgtccgctaaacaccagaggagcgctgcaaaatgatcacattgaatgacattccccacagcaccggcagccaggccgacctggcagtcgatgtcgccgtggtcggcgcgggcgtgggcggcttgtacaccggctaccgtctgctaggcggcgagtacaagccgggcggcagccggcccaccagcgtgcatgtgttcgacctggccgaccggctgggcggcaggctgctgtcaatcaagctgccgggcatgaacgtgattggagagctgggcggcatgcgctacatgcgctcgcaggaaatggtgaccgccctgatcgaagacgtcttcaagctgcccaaccaggaatttcccatgggcgaaccggacgatctttacttctacctgcgctgccagcgcttcaaggccaacgcctggaccagcgctcaggcgcaaggggagaaattccacgtccgctataccttcaaactgggcgaagaaggctatagcccggaccagttgttcaacaagatagtctacgacgtgctgatggccgacccctggttcgtcgccgaattcggcgacaaggtcaaaaagatcgaccaatacacctacacgttccagctcaccagccgcgaatggaacatcgtcaagccagccctgacatacgttttccccgacagccccttccgcggcatgaaggtcaacgatatcggcttctggaacctgatcaaggaccaggtaggccaggacgcctacagcttcctggccgatggcggcggctactattccaacaccatcaactggaacgccgccgaagccttcccctatatggtgggtgacttttccagcgccgactccagctaccgcaccatcagcgacggctatgatcagatcgcctacgcgctggcgcagtccttcaccgacatgtcaggcgccaagctgtggctgggcaaccgcctggaaaccttcagccgcgcgcaggacggcagcggctaccgctacctgctgaccttctggaatgccgctggccaataccgctggaccgtcaaggccaataacatcgtgctggcgatgccgcgtcgttcgctggagctgctcgaccagcagaattttttcttcaaccgcgaaggcgcgcagcagctgcagaagaacatcgcctccgtcatcatggagccttcgttcaaactgctgatgggctttgaggagccatggtggacagaagacttcggcgcggagtccggccattccatcaccgacctgccgatgcgccagtgctactacttcggcaccgatccggccaacaaccattcgctgttcctgtccagctacaacgacatgcgcaccgtgccgttctggcaggtgctgatgcaaggccgcgacaaactgccccgctacctgggccacaccacccggctggtccgccaggagcatctggaagcgctggccaaagagccaggcgagccagcgcccatcgcgatggtggaagaagcgatgaaccaggtgcgcgaactccacggcaagggcaacgagattccgccgccctatgtcgcccgcctgcaggactggacccaagacccgtacggcggcggctaccacgcctggtgcgccgacgtgtcggtgcagaacatcatgccctatatgcgtcggcccgatcacggcgagaacatccacatcaccggcgaggcctattccgacgaccaaggctgggtggaaggcgcgctttgcgtgaccgagctgatgctgcaggagtggttcgacatggcctggccggcctggctgaaccgagactactacctgggctggtgaagcgcggccgcctccgcctagccggacgcggcggcgtcatctttcgggaaaggacgcggccgggccaagacatgcttgcgccaggccgcggcctcgcgtcaattcgcggcttgaatcaacacgcgcgtttgcccggcattgtcccgaccatagtcgtcgctgacataggcatcatcgtcgacgcggtggacgatcagcggctcgtgaaagcgcaatgcctctgatcgacatgcggcctcgtctcaaaaaacagcgcgcaccctcaggatgcgcgccgttgcactttcttccccgactcaaaccagggacgcgtccttacatcgccgccaccaccgcgtcgcccatgccggagcagctgaccttctcgcaaccggcctcgtagatgtcgccagtgcggtaaccctgggccaacaccttcttcactgcggtttccacgcgctgcgcggcggtctcctggccgaagctgtagcgcagcatcatggcggcggacaggatggtggccagcggattggccaggttctgcccggcgatgtccggcgccgagccgtggctgggctcgtacaggcccttgttgttctgatccagcgacgccgacggcagcatgccgatggagccggtcagcatcgaggcctcgtcggacaggatgtcgccgaagatattgccggtgaccatcacgtcgaattgcttcgggttgcgcaccagctgcatcgcggcgttgtcgacatacatgtgcgacagctccacctgcggatactcgcgcgccacgtctatcatgatctccttccagaactcggtggtctccagcacattggccttgtccaccgaacacagcttcttgccccgcttcatcgcgatgccgaaggcgacatgggcgatgcggcgcacttcgctctcgctgtagcgcatggtgttgtaagcctcgcgctcgcccagctcgttgacggcgatgccgcgcggctggccgaagtagatgtcgccggtcagttcgcgcacgatcatgatgtccagccccgccaccacctcgggcttcagcgtggacgcgttggccagctccggatacaggatggccgggcgcaggttggcgaacaggcccagatccttgcggatggccaacaggccgcgttccggccgcagcggacgctccagcttgtcgtattgcgggccgcccaccgcgcccaaaagcaccgcgtcggcctcgcgcgccagtttctgcgtggcttccggatacggcgcgccgtactggtcgtaagcggcgccgcccaagggcgcgtgctcggtttcgatcttcagcccgtcgcggcgcaatacgtccagcacgcgctcggcctgcgcgatgatttccggcccgatgccgtcacccggcagaatggcgattttcatggtttcttccttatttccgtttgtcttcttcgcgccaggtcaaacgttccaccagcgccttttcgcaacacttgaacacgatgtaggccgccatcgcggcgtagccggacagcagcagctctcccaactggcgcagcgcgccatccattgccgcctgccagcccgcgtccagccataatttcaaattcagctgcagcagcagggccaggttgatggtgcccacgccgaacagcaaaaaactcaggcccagcagcaggaaagccgccagcggatggcgatgcagccaggccatccctccccgtcgcgctgcggcttccttcccgccgccatcttcactgctgacgggtttcatcggcgcttgccagtccgctcttttccacaatgccggtcggcagcccatccaggctcgacacattccggctgcgccagtagtcttgcacccccgcctcgcctttggtccgggcccagtcgttcaactgctcccgctcgccctggtattggtagtaaggaaccgacatgccgcaagaggactgcgccagccccacgtccagcaaaaagatctgccgcgcaccgggcaagggttcgaacaggccgtaataatcggcccattccgggtcgccctgatgaatcgcccgcgcctgcccatacaggcgcaaaatcagcggcttgccttcgaacgcgcagaacatcaaagtcatgcgcgggctgtgttcgacatggcaggccgtctcgttgccgctgccggtgacgttcagccaggccacttgattcggccccagcacccgcagcgaatccattcccttgggcgacatgttgacgcgcccatcctgcatggcggtagcgacgaaaaacagtttctgcccggcaataaactcgcgatgcgaatccttaagctccagataacgctgtcccatctcgctacctcctatgcgttgaacaatcctctcaggcgaacaaccagggctgctcggcgcggcgcttggcttcgaaagccttgatttcgtccgcgtgccgcaaggtcaggccgatttcgtccagcccgcccaacaggcagtgcttgcggtgctcggtgatgtcgaacgggaaggcctggccggacggggtggacacggtttgcgccgccaggtccaccgtcaggctgtagcccggcgccgcctcgcactcgcggaacagctggtcgacggtgccggcgtccagcacgatgggcaacaggccgttcttgtagcagttgttgaagaagatgtcggcaaagctgggcgcgatcaccacccgaaaaccctggtcatccagcgcccatggcgcgtgctcgcggctggagccgcagccgaagttttcccgcgccaacagcacctgcgcgccctgatagcgcggctggttcagcacgaagtccggattgagcggccgcttgctgttgtccatgccgggttcgccatggtcgaggtagcgccattcgtcgaacagattgggaccaaagcccgaccgcttgatcgacttcaggaactgcttgggaatgatggcgtcggtatcgacgttggcgcggtccagcggacaggccaggccctgcaaagtggtgaatgctttcattttctacgctccgttgcgcggcagcggcggtttactcggcggtgcgcttgatcgcctcgccgcctttttccaccgcgttgccgattgcctggcccgccttctgcaggccgtggcccaccgcctggccgccttccttggcgtcggtcttgatgccctgcacggtgttgcacgccgccagcagcaaggccaggccgatccagacaatctcttttttcatgatgcgaaactccattcgataaacagccaggctgtcggataagtaaacagggtgggattctacccaagccggcatcgccggtctgccccatccttaggacacgacgcctggcgttttgctcccggcgggccgggacaaaacgctgcttatcggacggaccactggcgcacgtcgacgaaatgccccgccaccgccgccgccgccgccatcgccgggctcaccagatgggtgcgcccgccctggccctgccggccttcgaaattgcggttggaagtggaggcgcagcgctcgcccggcagcaggcggtcggcgttcatcgccaggcacatcgagcaacccggctcgcgccattcgaagccggcggcggcgaacaccttatccaagccctcggcttcggcctgcgccttcaccaggccggatcccggcaccaccagcacctgcttgacgttggcggccttgctgcggcccttggccaccgcggcggcctcgcgcaggtcctcgatgcggctgttggtacaggagccgatgaacaccacgtccaccggaatctgatcaatcggggtgtcggcctgcaagcccatataggccagcgcgcgctcgatgccggctttcttcaccgggtcgctctcgcgggccgggttcggcaccttgccccccacctccaccaccatttccggcgaagtgccccaggtcacttgcggctggatagccgcgccgtccagctccaccaccgcgtcgaaatgcgcgccggcgtcggaatgcagggtgcgccagtaggccaccgccggttcccactgttcacccttgggcgcgtacggccggcctttgacgtattcgatggtcttgtcgtccaccgccaccaggccggagcgcgcgccgccctcgatcgccatattgcacagcgtcatgcggccttccatgctcaggccgcggatcgcctcgccgccgaactctatcgcgtagccggtgccgccggcggtgccgatcttgccgatgatcgccagcgccacgtccttggcggtgacgcccgcgcccagcttgccgtccacccgcaccagcatgttcttggacttcttggcgaccaggcactgcgtggccatcacgtgctccacctcggaagtgccgatgccgtgcgccagcgcgccgaaagcgccgtgagtggaggtgtggctgtcgccgcacaccacggtcatccccggcagcgtggcgccttgctccggccccatcacgtggacgatgccctggcccttgtccttgaacgggaagtaggccagcgcgccaaaggcctggatgttggcgtccagagtttccacctgctggcgcgagatcgggtcctggatgccctgatcccaatggtcggtcggggtattgtgatcggcggtggaaaccaccgaatccacccgccacagctggcggccagccagtttcaggccttcgaaggcctgcgggctggtcacttcgtgcaccaggtggcggtcgatatacagcagcgcggtgccgtcggcctcctggcgcaccaggtggctgttccacagtttgtcgtacaaggtttgcgcggtcatatggcgtgtcctcgggtcgtcgttgcagacatctttgaccagctttgatcctgttacaagataagccgttatactggtataaaaaccaacaggatcagactatggaatccccgtccgccaccccgctcggcgccttcctgcgcgcccaccgcgaacggctgacgccgcagcaggccggcctgccgacgggaacgcgccgccgcgccaagggcctgcgccgcgaagaggtggcgcaattggccggcatcagccccacctggctgacctggctggagcaagggcgcaccgagtcggtatcagcccataccctcacccggctggcggccgcattgcagctgtccggcgcggaaaccgactatctgtttgatctggccgggctgaaaaaccccaaggacaagcgcgccgaagacaatccgcaggcgcgggacattctggccgaaatgctgccgcacatcgccatcccggcttatgtgttggaccgccactggcgggcggcggcctggaaccccgcggccgcggagctgttttgcggctggctgggcaagccggaggccagccgcagccagctcgacttcattttcctggcgcccgaagcgcggaccttcctcgacaactggccggagagggcgcggcgcatcgtggcggaattgcgggccgacctgggccagcagctggatgacgcggaaaccgcggacatgctggagcggctgcgccgcgacagcgcggagttcgaccgcctatggcaacagcaggatgtattggagcgcgaaggcggcgagcgcgccttccatcaccccacgctgggccagctcaacaagcggcagatcacgctcaggccggccaacgcgccggagttcaagctggtgatgctgctatgactcggctggcggccccagatgctcctgcagcagccgccagccctgcccatccttgatcagcgcgcagctgccgcggcctcgcccctccgcgggctgcccatcgaccagcccgcgccaggaaaacgcatagacgcaggcggcgaaattctctcccgcatgagtccagtgcagatccgcgatgcggtaatcctcgccgcgtatccagtcaaaagtttgacggatggcctcgcacacggccgccttgcccttgaaggtgccatcggaaaacacgaagcaagcgtcttcatgcagccacggcgccacctggcgccagtcatgcgtcgccaaagcctgctggtagctgtccagcgcctgctgcggcgtcatggccatcgtcattggcatgcctgtcgcttgggcctgagccagcgcaggcagacgaaaacgccggccagcgccgcgccggcggacatggcgaaggtgggcagcacgccgccgtgcggccacaccagcccgcccaccagcccgccgccgctgccgcccaggccgaacgaggcgatgatgtacagcccttgcgcgcggccatggtgctgctcgtcgaacatgcgattgatcaggcctatcgccgacgcgtggtgcaaggcataggtgagcgcgtgcagcgcttgcgccgccgcagccaaggccggcagcgacaggccggcggcgatcaggccgaagcgcagcaccgccgccagcagcgatgccagcatcaaagcctccaggctgaagcggcgcatgatgcgcggcatcagcatgaacacgcccacctcgaacaccacccccagcgcccacagcacgccgaccgcggccttgtcatagccaaactgcttcaggcccaaagaatagaaagtgtaatacgggccatgggcgaaggcctgcaggaaacagcaggcgaacagcgcgatcaccgccggctttttcagcgtgtcccagatcggcccggctggcttgccgcggctggccagcttcacctccggcaccttgagcgccgtcagcgccacgcctatcagcaaggcggagacaatccacggcgtcgccgcgatgcccagccagtccagcagatagccgccggtcagcgccaaacagacgaagcctatcgacccccacacccgcacccggctgtagcggccgggctgcgcccgcgtcaggtaggcggtgctggcctccaccagcggcagcgccgccgcccaaaagaaatgcgacaccgccatgctgacgaaaatccaccagaagccgttgtgcagccccaccaggcaaaagctggcggcggacaggatggaagtggtgacgatgatgttgcggcgttgtccgctcttgtcggccagccagccccagaagcccggggcgatgatgcgcgccagcgtggatagcgccatcagcaccgaaatctgcagcgcgctgaacgacagcgactccagatacaggccccagaacgggctgaacatgccctggaaggtgaaataggtgaagtagaacccggcgaacggcaacaacgactgcattgattgtctttctattcgaatcagcccggcaccaggccgggctggcgccgcggcggcggctaaaacgacgacttgaagcgggagatgtcgcgccgcgctttcttggtggggcggccgtcgccatgcggaaagctggcatgctcggccttcagcagcagcatgcgcgcttcgcgggcagccaccgactccgcatcttcgcggtacatcaacaccgcctccttcgccggccggcgctgggtggcgagctgcagcacttccacgttgtactccagctggttgatccgcaaaaacagccggtcgccttccttaactacacgcgacgccttgacccggtcgccgttcaccagcacccggcccagctccagcgcctcgtgcgccagctggcgcgtcttgaagaagcgcgccgcccacagccatttgtccaggcggaccttgccgtcgtcctgctcttccggccgcgccatcacgccaccttccagtgcgcggacacctggccgtgcaggctgagatccagctcgtcgccggagcggatgcgcgccacgccttccggcgtgccggtgtagatcaggtcgcctgcgctcaggccatacgtgcgcgacaggtagctgatctgctgcgccacagtgaacagcatcatgccggtgtcgcccgcctgacgcagctggccgttcacccgcagttcgaattgcagccgctgcggatcggccacccgctccgccggcaccagcgccgacaagcaggccgcgccgcgaaagccctttgccttggtccacgggtggcccttgctcttggccgcgctttgcgcgtcgcgggcggtcaggtccagcccgacgccgtagccggcgacatggctcagcgcctgttcgggcgcgatgtcgccgccgcccttgcctatcagcaccaccagttcgcactcgtgatgcacgtcgtcggaatattccggcaaatgaatgggagaggattcgtccagcaaggccgaagtcggtttgaggaacaccagcggctcgctttccaccgggtttcccaattcggccgcgtgggcggcgtaattgcggccgatgcaaaagatgttttcaacgcggatggtatgtaaagccagttttacactcgccattgcaattcctcataactaatccggtcaattatcccacaagcgatgcgaaagccataatgcggcgcgatttggccgccgccattttttgcgcattgcagcaacagtcaccggcatttgccagcccttgccgccgggagggcgtgaaaatgtcatgcaaccctgttacagtctgcaggtacattcgcttgaccatgcattccaaacagattgattcagacaggcttcgataacgctatatcagtacgtatcaggagattcatcttgtcccagaataataccgctacgctggaagatttcttcaccggcctctccgaagccaaccagcaatggatgcagcagttcgtcaattccctgtcgctgggcgcgagcccggacagcgccgcccacccgctggccggcgcctggtcgcagctgatgaatcagaccaatcagctgttcagcctgcagtccgccctgtaccagcaacagctgaacctgtggtcgcagtttctgggcaaggcggcggacaccgcgccggaggccaaggccggcgaccgccgcttcgcctcgccggaatggaacgaacacccgttctacagctttctcaagcaaagctacctgctgacctccaagtggatgaccgagctggtcgaccagacccagatcgacgaaaacgccaaggacaagctggccttcgccacccgccagtacctggacgcgatggcgcccagcaacttcatgctgaccaaccccgacgtggtcaagcgcgccatcgaaaccaagggcgaaagcctggtggaaggcatgaagaacatgatggaggacatccagaagggccacatctcgatgtccgacgagagcaagttcgagatcggcgaaaacctggtgatcacccccggccaggtcgtgttccgcaatgagctgatcgagctgatccagtacacccccaccaccgaaaaagtctacgagaagccactgctgttcatcccgccctgcatcaacaagttctacctgatggacctgcagccggacaactccatggtgcgccacttcgtcgcccagggctaccgcgtcttcctggtgagctggcgctcggccgtggccgagatgaagcatttcacctgggaaacctatgtcgagaaaggcgtgatcgccgcggcggaagcggtgcgcaaaatcaccaagcagccgacgatgaacgcgctgggcttctgcgtcggcggcgtcatcctcagcaccgcgctgtgcgtgatgcaggccaaggggctcgactacatcgactccgccaccttcatgacctcgctgatcgaccacgccgagccgggcgagatcgcgtactacatcgatgaaagcctggtggccagccgcgaggccaagctggccgccggcggcatcatcagcggcaaggaaatcggccgcaccttcgcctcgctgcgcgccaacgacctggtgtggaactacgtggtcaacaactacctgctgggcaagacgcccacgccgttcgacctcttgtactggaacaacgacgcggtggacctgccgctgccgatgcacactttcatgctgcgccagttctatctgaacaacgcgctggtgaagccgggcgccatcaccctgtgcggcgtgccgatcgacatctcgaaaatcaatatcccggtctacatgttcgccgcgcgcgaagaccacatcgtgctgtggagctcggcctactccggcctgaaatacctgagcggcgcgccgagccgccgcttcgtgctgggcgcgtccggccacatcgccggctcgatcaaccctgtcaccaaggacaaacgcaactactgggtcaacgaacaattgcccatcagctccgacgaatggctggaaggcgcgcaaagccagccgggcagttggtggaaagattgggatgcctggctggcgccgcagtccggcaagcaagtcgccgcgcccaaggctctgggcaacaaggaattgccgccgctcttggccgcgccgggcagctatgtgctggccaaggcgatgccgagcgtgaccgccagcctgcaataaacgcccgcaaccggatcatcggtccctatcaggacacatggcccgccgccacggcgggccccaagccaaggagaaagacatggaagtcgcaatcgtagcagcgcaacgcaccgcggtcggcagtttcggcggctcgctggccaagatcccggccccggaactgggcgcaaccgtgatcaaagcgctgctggagaaaaccggcgtcaaaccggaagacgtcagcgaagtgatcctgggccaggtgctgaccgccggcagcggccagaacccggcgcgccaggcgctgatcaaggccggcctgccggtcaccaccccggccaccacgctgaacgtggtatgcggctccggcctgcgcgccgtgcacctggcggcccaggccatcctggccggcgacgccgaaatcgtcatcgccggcggccaggaaagcatgtcgctgtcgccgcacatcctgccgggctcccgcgacggtttccgcatgggcaacgcccagctggtggacaccatggtcaacgacggcctgaccgacgcctacaacgcctaccatatgggcatcaccgccgagaacgtggccgccaagtacggcatcggccgcgaagagcaggacgccttcgcgctgcaatcgcagcagcgcgccgccgccgcgcagaaagccggcaagttccagaacgagatcgtcccggtgctggtgccgcagcgcaagggcgacccgctggccttcgacgccgacgagttcatcaagcatgacgccagcgcggaaggcctggccaagctgcgcgccgccttcaagaaagacggcaccgtcaccgccggcaacgcctccggcatcaacgacggcgccgcggccgtgctcttgatgtccacccaaaaggccgaccagctgggcctgaagccgctggccatcgtcaagggctacgcgctgaccggctgcgaaccggaaatcatgggcatcggcccggtatctgccacccgcaaggcgctggccaaggcgggctggaccgtcgagcaactggacctggtggaagccaacgaagccttcgccgcccaggcgctgggcgtggccaaagagctgggctggggttcggacaaggtcaacgtcaacggcggcgccatcgcgctgggccacccgatcggcgcctccggctgccgcgtgctggtgaccctgctgcacgaaatgcagcgccgcggcgccaagaagggcctggccacgctgtgcataggcggcggcatgggcgtggcgctggcggtagagcgtccgtaagccgctcagtcgcgccaaaaaaaccgcctggcaacccaggcggttttatttttcccgggctgcgctcaggacaggaacacttccgccgcgcctagcagaggctgggccttgtccttggccgacaggttaagctctcccgccgcgggccagtcgatgccgagcgacgcgtcggaccacaagatgccgcggtcgtattgcggcatgtagtagttggtggccttgtacacgaactccgcctcgtcgctaagcgtcaggaaaccgtgggcgaagccttcgggaatccagaactgccgcttgttctcggcgctcagcaccacgcccacccactggccgaaggtgggagaggacttgcggatgtccaccgccacgtcgtaaacctcgcccgccaccacccgcaccagcttgccttgggcgtaaggcggcaattgataatgcaggccgcgcagcacgcccttggcggacttgctgtggttgtcctgcacgaaatccaccgcgcggcctatgccttcctcaaaccgcttcagattgaagctttcgaaaaaaaagccccgctcatcgccgaagaccgtcggctcgatgattttcacatccggaatgctcgtatcgattactttcatcggcccctggcctcgcaaatgactggcgacggtccccgctccgcgggcgaaaccttcgcgctgggattcaagaatttttcgcgcctatcatggccagcaggtactggccgtagccattctttttcagcggcgtggccaggcgcacgatctgttcgtcgtctatccagcccgaacggtaggcgatctcctccagacaggccactttcaggccctgccgccgctcgatggtggcgatgtactggctggcatccagcaaggattcgtgcgttccggtatccagccaggcgtagccgcggcccatggtttgcacgttcagcaagccttgctgcaggtaaacattgttgacgtcggtgatttccaattcgccgcgcgccgagggctggatggacttggcgatctccaccacctgcgaatcgtaaaaatacaggccggtcaccgcataattcgacttgggcagcgcaggcttttcctcgatggaacgcgccacgccggcggcgtcgaactccaccaccccgtagcgctccgggtcctgcacatggtaggcgaacaccgacgcgcccgcggtctggctgctggcctcggtcagcaatttggcgaaatcatggccgtagaagatgttgtcgcccagcaccagcgccgacggcgcgcccgccaggaacgcctcgccgatgatgaaggcctgcgccaggccatccggactgggctgcacctcatattgcagattgagcccccagcggctgccgtcgcccagcagcaattggaagcgcggcgtgtcctgcggcgtcgagatgatgaggatgtcgcggatgccggccagcatcagggtggacaagggatagtagatcatcggcttgtcgtagataggcagcaattgcttgctgaccgccagggtggccggatacaggcgggtgccggaaccgcctgccagaatgatgcctttacgtgcttgggtcattgttcgaatgatgtcctgtcatgccgcgagatagattcaatcacacaagcccacccctcaaaggcagggcccgcgcccccattccaagatcagacggccccttcggcttgcgacaacgcgtaaagctgatcgaccacgccatccacgccatcctcccacctgggcagccccagggagaaggcgcgcatcagtttgccgcaatccaaccgggaattagccggccgtttggccggcaacgggtattggtcgctgcctatcgcctggatagcgtccgccgtcagccgcagcgggaatccccgctccccggcccggcggatcacgcgctgggcatagccgtgccagctggtttcgccctgcgccgccaggtggtaagtgccatccgcgaaattttcgggccgcgcatgataacgggcaatcagctgcgccgtcacgtcggcgatcaaggcggcgcaggtcggcgcgccgaactggtcgcccaccaccttcagcgcatcgcgctcttgcgccagccgcagcatggttttcagaaagttgccgccatgcgcgccgaacacccacgaggtgcgcaggatcaaatggcgcgccccggcggcgcgcaccgcctgctctccagccaatttgctggcgccgtacaccgactgcgggccggtttcgtcgtcttcgcggtacggcgccggcttgtccccggcaaacacgtagtcggtagaataatggatcagcagcgcgccattggcggcggcccagcgcgccagcaccccaggcgcggcggcattgacggcgaaggcggcatcccgatcggtttccgccttgtccaccgcggtataggcggcgggattgacgatgatatcgggcttggcggcgtccaggacggcgagaatggcggcctcgtcggccagatccatccgcgcgcgaccgcaggccgtcacctcgccaagcggagccagcgcccggcgcaattcaaatcccacctggccatccgccccagtcagcaacacgcgcgtcatgcttgagcctcgtattgcttggccaaccattcgcgataagcgccgctgcttacgtttgccacccagtcctgattatccagataccagcgcacagttttacggatgccggtctcaaacgtctccgccggtttccagcccagctccttttccagtttgcgcgcatcgatcgcgtagcggcggtcatggccgggacgatcctgcacatggctgatctgatcggcataggagccgccgccgactttgggccgcatttcatccaggatcgcgcagatggtccgcaccacgtcgatattgggtttttcgttccagccgccgacattgtaggtttcgccgggcctgccggcctccagcacccggcggatcgcgctgcaatggtctttcacgtacagccagtcccgcacctgcaagccatcgccatagatcggcagcgccttgcccgccaacgcattgaggatgaccagcgggatcagtttttcggggaaatgataggggccgtaattattgctgcaattggtggtcagcaccggcaagccatacgtatggtgccaggcgcgcaccaggtggtcgctggcggccttgctcgccgaatacgggctgttgggttcgtagcgccgggtttccgcaaacggcggctcctgttcggacaacgtgccatagacttcgtcggtggagacgtgcaagaagcggaaggccttggcggcagcttccggcaggccgttccagtagccgcgcacgctctccagcagattgaaagtgccgaccacattggtatggatgaaatcgccagggccatggatggaacgatcgacatggctttccgcggcgaaattgatcaccgcgcgcggctgatgctcgctcagcaaccggtccaccaacgcccgatcgccgatatcgccgtgcgcaaacacatgccggcggtcatgcttcagcgatgccagagtttcgagattgcccgcgtaggtcagcgcatccagattgacaacctgctcatcgctgccggccaaccagtcgagaacaaagttggcgccgatgaagcccgcgccgcccgtcacaataattgtcattatggcattccgtttttaatcaagtttccaggcccgcgattgcccgcgaaccgcattatccatgcaagcgcgccgcttgactccgcccagtcggggaatggccggcgcccgacgagcctcgtcgaatgcgcggtttggcgcgcgcgccccaagtatgccatttcctgacgacgccgtgaggccttgcgtaaggaacaaggcgctcaagccgtgtcaacaggcgcatcgcccagcaggaaacgggggccatcgcccaaacgggccgcgtggtcggcgggattattcaatttgcactttcgcagcgataggcagccgcagcctatgcaactgtccaattgatcacgcaattggcacaacgtatcgatgcgggcttgcagcataggccgccaggccgaggacaaacgcgcccagtcttccgcggtgggcgtccgctgccgcggcagccccgccagcgcctcgccgatgtcctgcaggctcaaacccagcgtctgggcaatgcggatgaaggagacccgacgcaggacatccttgtggaaacgcctgggctgccccgcctctcccacactttgaatcaagcctttcgcctcgtaaaagcgcaaggcgctggccgccacgcccgaacgtttcgccagcgcgcctatccctatccaattcgcagacatgcccgctccttgacttaaagttaactttaacttttatgctgaatgcgcatcataccactcaagaatcgatcggacatggcccacactttgattgtctatttctcagccgaaggcagcacccaccaactggcatgcgcgatacgcgacggcgccgcggcatacggcggcgccagcctgctgcggctggagccgcggcacatcgtcgacggccgctacgcgccgcccgcgatggccgcatcggccgaatcgctgcggcgagcggatgccgtcatcttcggcagccccacctatatgggcggccccgccgctcagttcaaggcgttcgccgacgctggcagcgcatattggcgcggccagccctggaccgacaaggtcgcggccggcttcaccatcggcagcagcctgaacggcgaccaacaaggcacgctgtcctatttcgcaacgctggccgcccaacacggcatgctatggtgtggcttggaccttcccggcggcaaacatatagacgatctcaaccgcctgggctgccaactgggcctgtgcgcccactccgcggatggttcgctgcaccccgccgacctggccaccgcccgccatcttggcgcgcgggcggcccgcgtcgccgatcgcctccgccgcaacgccttgcttgaagagaacgcgccatgacgcctgccatccaacggatagaccacatccatgtccatgtgagcgaccgcgagcaggcggaagcctggtatcgacgcgtgctcggtttcgagcgcattccggaactggcgttctgggacgccgacggcggcccgctcaccctggccaaccgcgagcgcacagtgaagatcgcgctgttcgagcgcggcggcgccggcaaacagcccgccgtggcgcttgaggtcgaagccgacgccttccaggcctggcgccgccacttgaagcaggcgctgggtcatgcgccggagctggccgaccacgccgtttcctggtcgatctactttgccgaccccgatggcaacggctacgaaatcacctgcaacgactacgccgcgctggcgcaaagattgcgggcctgcccctgacatccggccggccgcgcatgaaaaaacctcccgccgcatggaccaggaggtttgtttctcatgccggccatgaaccggacgattcggctcgacagagagccagaggaaaagcggcgcttatcgcgcttcaagccaggcggcaacgccagccggacgggccggacgcgccccggctagtggggaacaatgatgggggtgccatccggcgcgtgctttttctgatgcttggccgcgcgtttctccttcggcgacatcaggggttgtttcttggcttccttggtgctgtgtcttgatttgctcatgatccgctccaattggtgagcatcgggaacgcccgataccagccacagtatagtccgattgccgatggatggcgggacgcattccagcatccgcgcggcatggccgttgacggaaatcaaacagcgctcaaaacgcaaaacctcccaaaccgacaaaatgcctttatcattatccgcgcaaatcgatgaaccgccgccgcccctccgtcaaggcggcatgtctagccctggagccgccagcatgaaacatttcctgtcccacttcgtccacctgtgcaatctcgccggccgccccgggctgcgccgtctgaaaccgcgctgatccggcgccggattcgccccggccgcgccgatggactggacatggcagccatgagccattctcatccacttgcgcggcctttccattgctaacagaatgcatgcaatctttcttccggagctggcatgaacaccctcgcaaccccgcagctggacaccgttccgcaacgcatcgcctccttgcgcgccgccatgcgcaacgccggcgtcgacgcctgcctggtgccctcgtccgacccccatctttctgaatacctgcccaagcgctggcaggcgcgccgctggctgtcgggcttcactggttcgatgggcacgctgatcgtcaccgccgacttagccggggtctgggccgacggccgctactgggtgcaggcggaacaggagctggccggcagcggcgtgcaactgatgaagatagacacggccgccagcagccagcatctgcaatggctggccgacacgctgcaagccggccagacgctggcggtggacggcgacgtgctgggcctggccgccgccaaggcgctgcaagccgcgctggcgccgcgcggcatccagctgcgcaccgatatcgacctgatcgacgccgtcgatccgcagcgcgcgccgctgccggacgccgccgtctaccagcatgaggccgccttcgcgccgcaaagccgcgccgacaagctggcccgcgtccgcgaagccatgcgccaggccggcgccgagcgccacttcatttccacgctggacgacatcgcctggctgttcaacctgcgcggcgccgacgtcaattacaacccggtgttcatcagccacgcgctgatcgaagccgaccgcgccacgctgttcgtcgcgccgggcaaggtagacgcagccctcgccgcccagttggcggccgacggcgtccgcgtcgccgattacgccgcagccaaaccagcgctcgccgcgctggccggcggcgcgctgctgatcgacccccgccgcgtcacgctgggcctgcgccaggcggtggcggacggcgtcaaggtgatcgaggcgatcaaccccagcacgctgatgaaatcgcagaaaaccgccgccgaagccgcccatgtgcgcaaagccatggagcaggacggcgccgcgctgtgcgagttcttcgcctggttcgaagccaacgtcaaccagagccgcatcaccgagctgaccatagacgaagagatcaccgccgcgcgcgcgcgccggcccggcttcgtttcgcccagcttcggcaccatcgccggcttcaacgccaatggcgcgctgccgcactaccacgccaccccggaagcgcacagcgagatcaaaggcgacggcctgctgctgatcgactccggaggccagtacctgggcggcaccaccgacatcacccgcgtagtggcagtcggcgcgccgtccgccgcgcagaagcgcgacttcaccctggtgctgaagggcacgatggcgctgtcgatggcccacttcccgcgcggcacgctgtcgccgatgctggacgcgctggcgcgcgcgccgctgtggcagcacgatatcgacttcggccacggcaccggccacggcgtcggctatttcctcaatgtgcacgaaggccctcagagcatttcgcgcgcggtgccggagccgcatatggcgatgtgggaaggcatgatcacctcgatcgagccgggcgtgtaccgcgatggccagtggggcgtgcgcatcgaaaacctggtgctgaacgtggcgtcggaaaagaaccagttcggcgacttcctgaaattcgaaacgctgacgctgtgcccgatagaccgccgctgcatcgagcgctcgctgctgacccagccggaaatcgactggctgaacggctaccacgccgaagtgcgcgcgcggctgctgccgctggtggacggcgcggcgcgcgactggctgctggccaacaccgaagcgctgtaaactgcgggttgacccgcgcaggccatgccccccgtgggcatggcctgttttgttttccagaaagcccctatgccgtttgaccgactcaacgacctgcgcctgtttctcgacgctgcccagctgggcagcttttccgccgccggccgcaagcacggcctgtctccggccgccgccagcgcctgcatccagcggatggaagccgcgctgaacgtccggctgttccagcgcaccacccggcagctgaaactgaccgaagccggcgacacctaccgcgcctattgccggcaggcgctggagctgctggaagaaggggaaagccggctgcagcaggaacagcaggcgctgagcggcgcgatccggctgtcggcgccgtccgacctgggccgcaatcggctgctggattgcctggaccgcttcggcgcggaacatccgggcgtgtatttttcgctgtcgctcgacgacaccccggtagacctgataggcgaagacgtggacctggcgatacgctacggcaagccggccgacagcagcctggtggcgcgcgagctggccgccagccgccgcgtggtctgcgccgcgccaggcctgctcgcgcgactgggcgcgccggcccatccgcggcaactggctggcctccccaccctcaccctcgccaccgggcacgggccgatgaacgaatggcgctaccgcgagcgcggcgaagcccgctccctgcggctggagcgcgcgcgccagagcaacgatggcgaggtcatccgccgctgggcggtgcaaggccacggcttcgcctacaagtcgcagctggacatcgagccggacctgcgcgccggccggctggcgactgtgctggacgactacttcaccgaacaggcgccgctgcacctgctctacccaggccagcggctgcagccggcgcgcatccgccggctgatagaccatctgctggaaacatttgccggcaccacgcaaaaatgacaaaatcatttacatgacgccatcgtttctcgctacgggcaatctgctgccgctgctgcagcagatggaacagaccttgcaccagcccgccgcccgcgccgacgccgcgctgctggaacgctggctggacgacgacttccgcgaaatcggccgctccggccgccaatacgacaaagccgccatcatcgccgcgctgctgcgcgaaaatcccgatgcctccgccgcgacccactcgtccgattaccggctgaccctgctggccgaagacatcgcattgctcacctaccactcggcccatgccgggccggacggcgcgctgagcgggcacgcgctgcgcagttcgatctggaaacgggtgaacggcgcctggcggctggccttccatcagggcaccccggcgccctcaagttattgacactcgaagcacccgtgccaaccaccttagccgcctctctcctcaatacgcttttcatgaccgtctggatcgccatggcgatcggcggcctcgccttctccgcgctatgccgcgacgcgagactgaaaagaaaagtctcgcggatcgtgatgatcgccgcgccattgctgttctgcctgttcgcttggcatcagggcgcgcaagcgagcgaattcgccatcttcctcccgtttctggcgctgatcaccttcctcaatctgcgcaacacccgcttctgcgacgcctgcggcgccacccaacacaaccgcggcttctcccgtccgcgccattgctcgcaatgcggcgcctccttgccctgagcgccgcggccgggcttcacgacatttccaccggcaggccggccgccttccagtcgggaaaaccatccgccaaacgcctcgcggccagcccgcctgcccgcaaggccgccaccgcctggacggaaagcgcgcaaaacggcccgcggcaataggcgatgacttccagcccggccggcagttcggccaagcgctgcggcagcatctccagcgggatgttcagcgcgccgggcagatggccttgcgcgtattcgtcggccggccgcacgtccagcagcagcgcgtcgccatcgcgcagcctctccagcaacgcctcgcgcgatactgcctccgcgccatccgctccggcggacaagcggcccatttcgcggcgccgatgttccgcgcactgccgcaaggcatccagcagattgaccaccgggccgtcgcccagccggtaaagcacatgcttgccatcgcgccgcgacgccaccaggcctgcccgcttcagctgctgcaagtgctgcgaagcattggccaccgtcaatcccgccagttgcgccagccgctccaccggccgctcgccctgggctgcatgctccagcagcagcaggcggtgggcattgccgaccgtgcgcgccagctcggcgaattcatcgaacatccggccctggatatcgccatcgctcattgacatcactccattggaatatcatcattcaatttttcaattgaatgttatccaattttcccctaccccgccatcaaaccgcctcaaggagctcatctcatggatatcggactggaatcgctgcgttgggccgtgccgatcggcatcggcgccactttgctgatggatggctgggcctggctgcaaaaccgcctgctggccacgccctcgctagactacgcgctggtcggccgctggattggccatctggcacgcggcaagctcagccatcccagcatcgccaaggcggcgccgatacgcggcgaagcctggctgggctggagcgcgcactacctgataggcatcctcttcgccgcgctgctgctggccgttgccggcccggagtgggcgcgccgccccaccctggcgcccgccttgctgaccggcgcgctgacgctggccgcccccttcctcatcctgcagccaggcatgggcgccgggctggccgcccgcaacacgccgcagccgaatgccgcccgtctgcgcagcctgtcggcccacatgtccttcggcatcggcctgtacgcgtcggccggcatgctctgcgcgctggcgccgttttgagacttctggcggtcgacgaatcggtagtccgggcggcgtctttcgccgccctgtcaaccagatccgccctcttggattaaacagtgtactaggcgggcgcaaactgaataaaatgcatgccaatcgtcgattccgagcagactgcttctcaatacagccaggacagaacaagaatgaaaaacatgtttttgctgggactgagcctagcctcagccccaatcgccagcctcgccgccgcgcaagccgaaccgcaaaccgccgaacagcaggttgaccgctacggcagccagatattccgcgacagccgggccgtcggcatggtgatggtggtggtcgacaagaaacaaaccctgcagcgcttctacggccagacccgtcccggcagccgccagaaacccgatgccgattcgctgctgcgcatcgccagcatcagcaaaaccatgaccggtgaagtgctgtcgtcattggcgctggaaaaccgcgtcaagctggacgacccgctgcaaaaatacgctccccaaggcatggcgctgccgcaagccggccaatccatcaccctgctcaacctggccacccataccagcggctttccgcgcgagatgccgggcagcaagccgcaggacacgccggtattcgtctggcccgaccagcagcagcgctggagctggctgagcgccagcaaggcccgcttcgccgccggcgagaaagcgcagtattccaatctggcgttcgatttcctggccgacgcgctggccgtggccaccggccggccttacgcggcgctgctgcgcgacaagatcaccgcgccgctgggcatgaaggacaccacgctgaacccgaccgccgcccaatgcgcgcggctgctggaaggcttcggcgccagcccctgcgtcaacaccaccgcggccagcggcagcggcggcatctactccaccccgcgcgacatgcaacgctggctgcaagacctggtctacccgcaggacgccgcgcgcaagcaactgcgcgaccagatgttccgcatgtacttcaaacgcgacgacctgcgcagcttgcgcggcatggatgtggcgggccaggctgacgaactgggcctgggctggatccggatgcaggaaaagccggacgcgccggaaatcatccagaagacggcgggcggcggcggcttcatcggctacgtcgccatcgcgcccaagcatgacgtggcggtatgggtggcgctcacccgcagcggcggcacccactaccacaatatgagcggcggcgcgaacaagctggtggcggaattaagcggctaccagcccgccgcgctggttgcgcccaagccggtcgccgcccgcaaaaccgcagctcacaaggcggtggttagcaagccggccgcccgcaaaaccgctgcccacgcaaaaccggccgcgcgcaaggcggcggccggcaaaaagactcacaagaaacacaaaccggccaatagctagaacgccggcactccagaggcccgctgcgcgaagcgggcgatctcgtccttgcgcatgaagcgaacgccgtcatgcccctgcgcgtagcggatgaagtcctccagcaccttgacccgcgccgggctgccggaaatgcggtcatgcgtgctgatcgacatcatccggcgacgctggccggcctcgcggtacagcaggtcgaattcggccttcaggtccgccaggtaggcctcgttgctcagcgccggcgaatcgtagcggacgatgtcgttgttgcgcagcgtgtacggcaccaccacgaagggcttgccgttcaccggcaccgtgaacggctcgtcgcggctgacgttgtcgatgtgataaacgaagcccagttcctgcaggatgcccagcgtattgggcgtgccgcgcagccagaaggcgttgaagcctgtcggacgggtgccggtggcgcgttcgatgctggcgatgctggcgcgataggcgtcgcgctcctgctgcggcgtcatcgaatactgcggctcccaggtctggccatggccggcggcctcgtggcctcgcgccacgatctcctttgccagctgcggattgcggtccaccgcctgtcccaccatgtgcgaagtcaccttcaccccggtgcggtcccacaggtccagcaggcgcgggatgccctccttcacgccgtagtcgtaccagctttgcatcggcaaatcggcgtatttcgggtccagcggcgggaacggcccgctggcgccgcgctccggctgcgcgccggcttcgaactgcatggaaatggaaatcaccagtctggcgtctccgggccagaaacccgttttgccgctttcaagttgcgtcatgttcttgctcgctccatttgccgccagcgcgtcgccgtgcgccagcaacaggccgacgctgccggccgacgcgctggccaggaactggcggcggttgattgaaaaatcgttgctcatcgccggctccgcctatagcaagccgccgccgtccacatccagcaccgcgccggtgagaaaggcgttgcccatcgcgaacagataggcctgagccagatcctgcggccgccccaccctccccagcggcaggcccgcgccgatgcgcgccatcgccgcctggcggctttccgcgccgtccggcccccacagctcggtgtccaccacgccggggctcaccacgttgacgcggcgcggcgccagttccttggccagattcttcgccgccgcctctagcgcggcgttgaccgtgcttttcagcaagccgccggcgccgtatttgcgcgacagcagcccagaggtgaaggtcaccgaggcatcggccgccaggtagggcagcgcctggcgcaccgccagcacggcgccgaacagcttcacattgaaagtccgctcgaaatccgcccactccaccgccgccagcgtgggcgaccccacccgcgcgccggcggtcagcaccaggtggtcgatgcggccgatttcggcgaaggccgcgtccaggctggcgctgtcggtgacatcagcccgcagcgactgccatgggccgctgaccgtcggcgaacgccccagcacatacacctgggcgccggcgtcggccgcctcctgcgccaccgcccggcctatgccggagccgccgcccaccaccaccacactgcgttgccgcagaaaatccgcgttcaggctcatggcttcaccactcccagttgcttgagcagggtcaggttgtcttccagatgccagttttccgcgatgcggccgttcttcacccggtacaggtcgaaggcctggaaatccaccgcctgtccggccccttgcgcgtcgccgaacttgccggtgaagtgcccggtgaaatgcagacgcagcgatacccggtcgccggccaggatcatgtctgtgacctcaaccttcaaatccggcaccgccgcgcggaaagcgttcgacgcctgcagggggccggccacgccctggcggcgtccggcgggcaaggtgcggtcgatgaagtcggggtccagcgccagctcggcatagctcggatcgccggtgttccagaacgccgcatagcgcatggcggccagcttcaccgccgccgcggcgccgccgttgcgttcggaaaacacccgctgcggctgcggcaaggcctcgccggcggccgcgtggccagccagcagcgccagcaggcctgcggtcagaatatggggcaaacggttcatagcgattcctcgtgtcagacagcgccggccaatcgccggcacttgggaatcgattattgaaccatcagtttgaattgataattggtgtggaaattaaaggattttattgccaaattttaaaatgccgagcaaacgcgccgccggccagccggggagtggctgaggaagaacggccgcgacgccggcaaagaagcgagcaaaccggccaggaccggtacggcagccatgaaaaagcggcccacaggccgccttaattatcgcccgcgcgccaagcgcggctcactggctgcgcgccgctcaggcccgcacgtccacgttattgcccagatgcgccggattggacgcctggatctgcgccgacgactcggccgcgccctgcagcagggtcatcgcggtttgcgaatcggcctgcatcgcctttttcagcaccagcgcctgcgcattggtgctgacgttcgcgctcacttgacttactgcgtccataaccccacctcccggatagtatgcgtcactgcctgcagtttagccgcaagccggcctctcggcatagcaaaactgctagaatgtgcgccaccccccaccttttgacgacaggaaacacacatcatgagcgcaacccgtcacaaccctctgctgattctcggctccggcccggccggctacaccgccgccgtctacgccgcgcgcgccaatctgaagccggtcctgatcaccggcatggcccagggcggccagctgatgaccaccaccgacgtggacaactggccggccgacgccgagggtgtgcagggtccggaactgatgcagcgcttccagcagcacgccgaacgcttcggcaccgaaatcctgttcgaccacatccacaccacccacctgagcgagaagccgatccgcctggtcggcgacgccggcgaatacacctgcgacgcgctgatcatcgccaccggcgcttccgcccagtacctaggcctgccgtcggaagaggccttctccggcaagggcgtgtccgcctgcgccacctgcgacggcttcttctaccgcaaccaggacgtggcggtggtaggcggcggcaacaccgccgtggaagaagcgctgtacctggccaacatcgccaagcacgtcaccctgatccatcgccgcgacaccttccgcgccgaaaagatcctggtcgacaagctgatgagccgcgtcgccgaaggcaagatcagcctgaagctgaacgccaccctcgacgaagtgctgggcgacaacaccggcgtgaccggcgtgcgcgtcaagctgaacgacggcggcagcgaagagctggcgctgaccggcgtcttcatcgccatcggccacaagcccaacaccgacatcttcaagggccagctggagatggacgccaccggctacctgatcaccaagggcggacgcgacggcaacgccaccctgaccagcatcgacggcgtattcgccgccggcgacgtgcaggaccatatctaccgccaggccgtgaccagcgccgcctccggctgccaggccgccctggatgccgagcgctacctcgacagcctgaagtaagccgccgtgaagaccttcaaggactctttgaagggtcttcgccagacgctgcgccaggccgcccctcccccggcggccccggcgcggcccgcagcgcccgaagagccggatttcaagcaactgttccgcgacgtcaagccgctgaagcccgacggccgccatcatcccaaacccgcgaaacccagtccgcgcccgcgcaagcccagccagggccccgcgctgcacgccgccgcctgccaggaaatcctgcagcaccagataggctggttcgagccggcggcccaactgcaccaatacgcccgtcccggcatgccggccgccaccctcaagcggctgcgccagggctattggccgcaggccgcccagctcgacctgcacggactcgaccgctaccaggcgcaggacgcgctggcgttgttcctgcaccgcgcccgacagcgcggccaatgcgtgcgggtgatacatggcaagggcttcggctcgcaaggcgcgccggtgctgaaaaaaatggtgcgcagctggctgcagcaccatccggacgtgctggcgttttgcgaggcggaaagcggcatgggcggcagcggctcgctgctggtgctgctgcgccggcccagccatgcggacggccatggcgacgattgaaggatgacgtgacaatcccaactggaatccgctaagctcaaagcacggcggacccctgcacaccaccaggagttatgcatgacaggcacaccctgccccgacttcaccctgcccggcaccgccggcgccgagtttcagcttgcctccagcgacaaaccgctggtgatctacttctaccccaaggacaacaccccaggctgcaccaacgagagcatggatttccgcgacctgcacggcgagttcgccgccgccggcgcgcagatcgtcggcatctcgcgcgacagcctgaagtcccaccataacttcaaggccaagctggaactgccgttcgaactgctgtcggatgcggaagaaaccgcctgcagcctgttcggcgtcatcaaaatgaaaaacatgtacggcaaacaagtaagaggcatcgagcgcagcaccttcgtgatagacgcccatggcaatgtggcgcgcgaatggcgcggcgtgaaggtgcccggccacgcttcggaggtgctggccttcgtcaagacgctgtaaacggttgtacccgcccggccagccggccgggcaacaacatgaacaaggggaccacatcatggccggccgcaaaaagaccaccgcgtgcaagctgtttgttttggacaccaacgtcctgttgcacgaccccacctgtctgtaccgcttcgaagaacacgatgtgttcatccccatcatcacgttggaagagctcgacacccacaagaagggcatgtccgaagtggcgcgcaacgcccgccaggccagccgcttcctcgacgacatcatcagcggccaggagctgaagatcaccgaaggcatcccgctcaagcacgccagccgcgacgccgccagcggcaggctgatcctgcagacccaggccatcaacggcaccctgccctcgtcgctgcccatgggcaaggccgacaaccagatcctcggcatcgtgatggcgctgaagagccactaccagggccgctccgtcatcctggtgtccaaggacatcaatatgcgcatcaaggcccgcgcgctgggcctggaggcggaagactacttcaacgacaaggtgctggaagacaccgacgtgctgtacaccggcacccgcgagatcgaccagaacttctgggaacgcaacagcaaggacatcaagtcgtggcaggaccacggccgcagctactaccagctgtccggatcggactgcgccaacctctacgtcaaccagctgctgtggcaggaaggcgaaaagccgttccaggcgcgggtgatcaaggtggaaggcaagaccgcggtgctggaaacgctgaaggactacagccacaacaagaacaacgtctggggcatcaccgcccgcaaccgcgagcagaacttcgcgctcaacatgctgatggaccccaatgtcgacttcgtcacgctgctgggccaggccggcaccggcaagacactgttgacgctggcggccggcttggcgatgacgctggagcagaagatctacagcgaaatcatcatgacccgcgtcaccgtgccggtgggagaggacatcggctttctgcccggcaccgaggaagaaaagatggcgccgtggatgggcgcgctggaagacaacctcgacgtgctgaacaagagcgacgacgacggcggcgactggggccgcgcggcgacgcgcgacctgatccgcagccgcatcaaggtgaaaagcctcaacttcatgcgcggccgcaccttcctcaacaagtacctgatcatcgacgaggcgcagaacctgacgccgaagcagatgaagacgctgatcacccgcgccggccctggcaccaaggtggtgtgcctgggcaacgtcagccagatcgacaccccttacctgaccgagggcagttccggcctgacctatgtggtggaccgcttcaagggctgggaccactccgcccacatcacgctgcagcgcggcgagcgctcgcggctggccgaccacgccggcgaagtcctgtaaaccctccgattccggaaaaagcccccgcttgggggcttttccattgccgcgcctgtaaccgcggccattcgccggaaaagcccccgaacatgaaaaagccccgcaggcgcggccggcggggctgacgttcacctcacgacaagcttatttccagccggatgccgccaaggtcggcgcttcggacgcatagtcggccgacagcgacatctggcccgccgccggcgggttgaacgccgccatcgcgccgaccagcgcctgcgcctgcgaagccatcggcaccccagctgccgcattcatcgccatctggtccagctgccccgcgctccagctgccgccgtcggcgaaggtcaccgtcttcaccgtgccctgctggcgctgccagtcgaaccagccttgcacccggatcgagtcgtggccgttgacgtgctgcagcagcaggtcctggccgctttgcgacgcgacgatgtcgctttgcgcgatgcctgcgccgaagcggatctcgctctggcggctgctgtccaccgtcacgtgatcgtcgatcaccaggtcgttgccgtcgcccagattgaacacataggtgtccttgctgcggctgccgccatgcagcgtgtcgtcgcccttgccgccttccagcgtggtttcgtcgccgctgccgatcagcacgtcgttgcccgcgccgccgcgcagagtctcgctgtcagggctgttcgaaccgcggatggtctcgttgccatcgctttcgcctgcgctcatttcacggaacaaatctgtcatttgaaaactccttattatcaatattcacgcactgcaatcatgccggtcaggttcgatgcgaaaacgttcgctccgcgcgcatccccacgcccagcaaatctcgataagcgacaatccccggttccaccccatagcgcgccgcggtccgccgcgcctgcgcgcgcatggcggggtcatccgcgcgcaaagcctccctcacccgcccgatcaaggcttcttggtcgaaaaagctggtcagatgcccgttgacgccgtcgcggatcacctcgcgcagcggcgcggtgtccgacgccacgatgcggcagccgctggccatcgcctccagcaggctccacgacagcacgaagggataggtcaaatagacgtgcgccgccgacacctgcagcgccttgcggtagacctcgtacggcaccttgccgaggaaatgcacccggttcgggtcgaccgggttttcccgcagcagcttctcccgccagttggcggcatcggccggcgcattgccgtagctgacgccgtcgccgccgacgatcaccacttggcaatcgggctcggcccgcaataaatccggcagcgcgcgcatgaagatgtggaagccgcggtagggttccagattgcgcgcgacgtaggtgacgatcttctgcccggcgcgcaattcgcggccgttcggcagcgtcaatgccgccgatggatccgggcccagccgttcggcgtggatgccctcgtgcgccacccgcagcttggcgcggtaagcggccgggtgcaggctgtgctgccagtgggtggggcagatgccggcgtcgcagttttccagattgagcagatgcagcgcattgcgggcgcgcagccgcgccgcgccatccaggctgagcgggaattccgggtcgaaatcggcgtcggccccctggccgtggtagaagaattcgcagtagtggatcagccgcgcgttcggaaacaggtctttcaggaacagcgtctcgccccagccggggtgggcgaggatcacgtcgggccggtagccgcgatgggccaagggctgcaagctgcgcagcaccgcctggccgtgcagcaccgcgtcctcgtagctgatcagatagggatgggtttcccggctgggccggcgatgcggcttgtagcgcagcagccgcacgccttgcaggccgggcgcggtgtcccgccccaccgccagcaggtcgatgccgggccgggttttcagatcatcggcgatgtggcgcagctggccggggaaattctggtggatcagcaggatcttcatctcaacgctcccgcatgccttcgccgatgtgctcctgcagcgggctgaggaagtagtcgatcacccggcgcttgccggtcttgatctcggcgctgaccgccatgccggcgctcaagttgacgcgcgcgccgtctatcagcagatggccttgcctcagccggatgcgggcggggaacagcagaccgcgcttttcgtcctgctgcgcgtcgtggctgacggtttccaccacgccgtccagatagccgtagcgggtgtagggaaagctttccactttcaccgtcaccgcctggccgggccggacgaagccgatgtccttgttctcgatctgcgcttccacttccagcgtctcgttggcgggcaccacggccagcaagggctgcgcttcggtgaccacgccgccgacggtgtggatggccagctgctgcacgctgccggacaccggcgcggtgagttgggtcagcgcctggcggcggccggttttcttcatttcctcgccggattggctggcctgctcgcgcgcttcgcgcagcttgcccagcgcgtcgctgcggaagttggcggtcagcgcttgcaattcttcgcgctggccggcgatggctgcggccagctcctggatgcggctttgctggctggccaggtcgccctgctgctcgatgcgcgcctgctgcttgtccagataggcgtgcctggagatgaaattcttgtccagcagctcctggtagtcgtgctcgcgcgcctcggccagccgcgccgtgccttgcagcttgcgcacctgctggcgggtggtagagagttccgcctcgcgctggcgcaaggtggcctgcagcgcctcgcgcttcgcctggtaggcgcgccactggccgacggccagggtttcctcgctcagttgcttggccggatcgacgccgtccagcttctccagctgcggcagccggccattgtccagcgccgccagcagcgcctggtagcgggcggcggccaggcgggcggtttccagcgcgtcgccggccttgcggttgtcggcgccggcggcggtggcgtccagctcgatcaacaactggccggccttgaccagctggccgtcgcgcacgtggatggccttgaccacgctgggctccagcggctggatgatcttggtgcggccgccgctgacggtcttgccgccggcgacggcgacgatgtccaactggccgatcagcgcccacaagaacatgcaaagacacaacgcgacgatcacccgcatgctccagcgcggcaacggcgacaccgggctgtcggtcagttccaggtgggcgggcaggaaggccagttcgtcctcgctgcgcggcttggggtcgagctggtggcggatggaccaatattcggcgaaggcctggcggtagcggcgcaggaaatcccgcaatgcctcaatctgctgcttcatcgcggcttatccttgctgcaggctgtggaggtgggcgtagtagccgcccggtttctgcgccagctcggcgtggctgccggcctcgacgatcacgcccttgtccatcgcgatgatgcggtgggcgccgcgcacggtggacaggcggtgggcgatgatcagcaccgtgcggccctggcagatggcgcgcatgttctgcatcaccgcgcgctcggactcatagtccaaggcgctggtggcctcgtccagaatcaggatgcgcgggttgcagaccagcgcgcgggcgatggcgattcgctggcgctggccgccggacaggctggcgccgtgctcgccgaccatggtgtcgtagccctgggccagctccatgatgaagtcatgggcgccggccagcttggcggcgcggatcaccgcgtccagcggcatgccgggatcggacagcgcgatgttgtcgcgtatgctttggttgaacagcaggttttcctgcagcaccacgccgatctggcggcgcagccaggccggatcggccagcgccaggtcgttgccgtccaccagcacgcggccggactccggcacgtacagccgctgcaccagcttggtcagcgtgctcttgccggaaccggagcggccgacgatgccgatcacctcgcccggccggatctccaggctcagcttgcgcaggatctccgggccatcggggcggtagcggaacaccacctggtcgaactcgatcttgccctggatgggcggcagcgccgcgcggctggccggcagctcggtgcgggtgttgaggatgtcccccagccgctccaccgagatgcccacctgctggaagtcctgccacagctgagccaggcgcaccaccggcgccgccacttgtccggccagcatattgaaggcgatcagctggccgaccgacagatcgccgcctatcaccagcttggcccccagccacaaggtggccactgtcaccagcttctggatcagctgcacgccgttctggccgatattggccagccgcgtcacgcggaagccggcggccacgtaggcggccagctgcttgtcccagcgccgggtcatgtgcggttccaccgccatcgacttgatggtgccgatgccgcccaccgactccaccaggaaggactggttgtcggcgccgcgggcgaacttctcgtccagccgccggcgcagcaccggcgtcagcagcgccgaccaggcggcgtagcacggcaaggaaatcaccacgatcagcgtcagccagccgctgtaatagaacatcaccgccaggaacacgaaggagaacagcaggtccagcaccgtggtcagcgcctggccggtgaggaaattgcggatgctgtccagctcgcgtacccgcgccaccgtgtcgccgacgcggcgcgcctcgtaataggccagcggcagcgccagcaggtggcggaacagccgcgcgcccagctccacgtcgatgcggctggtggtgtgggcgaacacgtggccgcgcaaggcggacaacaccacattgaacaccgacaacaacagcaggccgacggcgatcacgtccagcgtgttgaaagcgcggttgaccagcaccttgtccatcaccacctggaagaacagcggcgtcaccagcgcgaacaactgcagcgcgaaggacacgcccaacacctccagcagcagcttgcggtacttgacgatggccggcacgaaccaggtgaagtcgaacttggccaaggcgccggccgccgacgcgcgcgatgccgccaccagcagccggccgtcgtagcgcgccgccagttcgtccaggctcaacaccacgggacgtccctgcttcagatcatggatcagcgccttgtcgccatcgcagcgggcgacgatgaagtgctcgccattgaccgccagcgcgagcgccggcaaggccatcaggccgatgcgctccagcggttgcttgacgatcttggccttcagttccagctgcttggcggcaaggaggagatcggtttcggaaaagcgttcggcgctgcggccaaactggtgggagagctgcgcggggtcggcggcgatgccatggaactgggccagcaacaccaggcccagcaaacccagatcatgcggaacaacctgctccggaacatcctgagcgctttggtatttcatgaaaattaacaataatccagttatttttcatattttttaacaactgcgacaaagcgtcaacggacaaacccggtgcaaagccgattaattgcgcttgaaaattaccaattcagaaaaaaaaggacaaaatagaacattaaacgccacgtcaatggcagaaaatagccaaaattcacacaactcaacggcgcagccggccggttgcggcatccggcccgtacagactccattcgctgatcagcagcatgccgtcgctcgccgccaccagcaactgatcggcttgcgaataaatcaggctgcccggcgcgaagccatggctttccacccagccttcggcgcggtggatgaaaatggtgatgttgttgatggtggccgcgcattcgaaatcgccgaaggcgcgcagctggcgctgcaagtcggccaccggccgggtgaaatcgagcatgcgctcctgttcgctccacagcggccagtaactgcccccctccgcctgcggcgcggcgtcgcgccatgacgcttcgaaattgtgcgccaccgtccggctcagccggtaaagcgcgagttgcagcttgacgtccagcgtctggtggctttccgtttccgacaatggaaaccgctcctgcgccagcacctcgccggtatcgaaatccgcggccaccttgtggcaggtcgcgccccattcgcggtgcccttccagcagggcccgcacctgcgggtacggcccgcgcgcgatgggcagcggcgaaggatggaaattcaccgcgtatttcagatagggcgtccagtccggtatgcgccagttgtagctggccaccagcaaggcctcgcaaccctgttcggccagctcctgcaaatcccgcggctgcatcggcgacagctgcagcggcagcttgcgctgctcggcgaaagccagggaagccttgtgatggtgcatgcggtggtccaccggcgtgcagaacactttgacaggctgccagcctgcctgcaggaaaacatccagcaccggcttgaagcggtcggacagggtaatggcgaaacgcatggcatccatttccggcaagcggggagaaacgcccccgatagcctcgttataccatccgccttccggccgccggcgccgatgacacgcaaattaacagaagcccgcgccggcgcgcgaaattcaagcctgggccgcgtccagccaatcgtcgaaggcctgcagcaaccgcgcgatgccggcttcggcggtgcttgggctcatcaacagcatattgtggaacggcgtgatcaacaggccgcggttgagcaggtgcaggtggatgcagcgctcaagctcttcgtcctgccaggcgccggcctcgctgccgttgcgcggcggccgcggcgcgaactggaattcgcagcgcgcccccagctgcgtcacgcaccatggcaggtcgcggcgggcgaacaattcgcgcaggccctgcgccagcctccctgcgcgctcaaacatgatccggtaattgtcttcggtcatcacttcggccaggttggcccgcatcgccgcgcaggccaaccggttggcgctcagcgtggtgccgatgccggagtgaccgggcggcgcggcccgcttggcctgctgcgccctttgcgccagctcggcgctgaagccataggcggcggccggcaacccgcctgccagcggcttgcccagcaccagcaggtcgggggccaaaccgtgcgcggcggcatagccgccggggccacagctgatggtatgggtttcgtccagcagcaacaggctgccgcggcggcggatgatggcctgcgcctgctcccagtagccgggatcgggcagcaccatgccgatattggtcatcgccggctcggccagcacgcaggcgacgcggccatcggccagcgcggcgtccagcgccgccaggtcgttgaactccgccacccgggtatgctcggtcaacgggtagacctgtcccagcaggctggcgcgcggccgcgccgcgccgtcgaccaggtcgacgaacacatcgtccaccgtgccgtggtagcagccgttgaacaccaggatctggtcgcggccggtcatcgcgcgggcccagcggatggcgaaacggttagcgtcgctggccgacagcgtgaactgccacgccgccatgccgaagcggcgggacaattcctccgccacccacaacgcgtcctcgccgggcagcatggcggtcaggccgcgcgccgcctcgcgcgcgatcgccgccgccaccggcgccggcgagtggccgaacatcgcgccggtgtcgcccaggcagaaatccacgtattccaagccgtcggcatcggtcagcgcggcgtcgcgcgcttcggcgatgaacagcgagcacggcgtcggccaatcgtccatccagtgcagcggcacgccgaacaacaagtgcgccctcccccgctccgacagcgccagcgagcgcgggtgccgcgccaggaagccgcgtatttcccgctcatgccacgcgcgtgccttgtccagatcgatgccgtgccgcactgccatatccgcctcgccgtccgcgtttcacacgcccccagtatgccaaacccaggcggcgcgcgacaaaaagcccggaggggctgcgccgctccgggccaatcactgcaatgaacaggtgttcagcgcaggggcaggtgccccgccagcgtgttcacttgcctgatcgcgcggacaaagcgcgcgtgggcgcgggatacggtggattcgctgatgtccatctgctgggcggcggaataaccggtcatgccctccacttccatcagccacaccgcctcgcgcgagcgctttttcatgccgatcaggtcggccaccacattgaaatcgtcgattttcatgatgctcctcccagtgtcggcgccgtgcagccctggacgccggccttgtcgcgccacgaaatgcgcgggtgccatcccagcatagatgcttgcaaaaaaaatgcaggcacgcgcgaggccacgccaagccgatttttggaatatttaaaaataacaaatcacacaaatacatattgtgaatattttattttaaataaaaaccattatttgcaacactattccaatgaatttttccacccgcctcgctcggccggctcgccggccattcaacaaaaacacaaggaaacaatcatgagcatggaaaaccaagccgcgcccgacagccgcgtcatcaacgtgcgcgacagcgacagccgcaccgaaatcgataccgaccccagcctgggccgcatcgcggacatccatttccccgatacgcccgactacaccgtgcgcggcatggtgcgccagggcgacgacctgttggtccagttcggcaataaccagcagctggcgctgaagggccactacctgggcgcggaccatcaattcggcaagatgagcttccagagctatgccagctggacctacgaaatgatgacccagcgcttcggcctgagcgtcgaaggcgcgggaccgttccacttcaccgacgccggcgaaaccatcaccggcaatgatcaaaacaacgccctctacggcgaaggcggcgacgacgtgctgcgcggcggcgccggcaaggacacgctggtgggcggcgcgggcgccgatggctatgccttcgccccgggcgacggccaggacatcgtcgatgcctacagcgccggcgccggccgccaggacagcatccacatcagcgccccgctctccatcgtcgacaagctgacgcggcaaggcgacgatctgacgctcagctacaaccagaccgacagcatcacaatcaagggtttcttcctgggcgcggaccaccagatcgccagcttcaacttcttcgacgccggccaaatcagcgccttgagctacgaagaactggcgcaacgcttcccgccgcagatactgggcaccttgggcgacgacaccctggccggcaccgacggcaacgacctgctgcaaggcggcctgggcgatgatttgctcatcggcggcaagggcgacgacaccctggagggcggacctggcaaggacaccctgatcggcggccgcggcaacgatctcttcgtgctgcgcgccggcgacggccgcgacgtcatcgacgctttcgacgactccgccgaccgtctcgacaccctgctgttccaggatgtctcccccgacagcatccgcaacgtccgccgccagggcgacgacctggtgttcgaatacggcccgcagcagccgtatccgggcctgggcagccaacccgaccaggtgacgctgaaggggcacttcctcggcgccgagcaccagatcagccagatcgccttcaacgacggcacccgctggagctatgagcagctggcggccaagctgccgatcgccgtggtcggcaacgacaccagctcgcatttcaccgacgccaatgaaaccatccacggcagcggcggcgacaacgccatctacggcatgggcggcaacgacctgctgctcggcggcctgggcgacgacttgctcgacggcggcaaaggcgacgacaccctggagggcggacccggcaaggacaccctgatcggcggccgcggcaacgacctcttcgtgctgcgcgccggcgacggccgcgacgtcatcgacgctttcgacgactccgccgaccgcctcgacaccctgctgttccaggatgtctcccccgacagcatccgcaacgtccgccgccagggcgacgacctggtgttcgaatacggcccgcagcagccgtatccgggcctgggcagccaacccgaccaggtgacgctgaaggggcacttcctcggcgccgagcaccagatcagccagatcgccttcaacgacggcacccgctggagctatgagcagctggcggccaagctgccgatcgccgtggtcggcaacgacaccnctgggcgcggaccatcaattcggcaagatgagcttccagagctatgccagctggacctacgaaatgatgacccagcgcttcggcctgagcgtcgaaggcgcgggaccgttccacttcaccgacgccggcgaaaccatcaccggcaatgatcaaaacaacgccctctacggcgaaggcggcgacgacgtgctgcgcggcggcgccggcaaggacacgctggtgggcggcgcgggcgccgatggctatgccttcgccccgggcgacggccaggacatcgtcgatgcctacagcgccggcgccggccgccaggacagcatccacatcagcgccccgctctccatcgtcgacaagctgacgcggcaaggcgacgatctgacgctcagctacaaccagaccgacagcatcacaatcaagggtttcttcctgggcgcggaccaccagatcgccagcttcaacttcttcgacgccggccaaatcagcgccttgagctacgaagaactggcgcaacgcttcccgccgcagatactgggcaccttgggcgacgacaccctggccggcaccgacggcaacgacctgctgcaaggcggcctgggcgatgatttgctcatcggcggcaagggcgacgacaccctggagggcggacctggcaaggacaccctgatcggcggccgcggcaacgacctcttcgtgctgcgcgccggcgacggccgcgacgtcatcgacgctttcgacgactccgccgaccgtctcgacaccctgctgttccaggatgtctcccccgacagcatccgcaacgtccgccgccagggcgacgacctggtgttcgaatacggcccgcagcagccgtatccgggcctgggcagccaacccgaccaggtgacgctgaaggggcacttcctcggcgccgagcaccagatcagccagatcgccttcaacgacggcacccgctggagcggcgacgaactcgccagccgcttcgccgtgaccatcgagggcaagggcggctcctaccgcttcggcgacgccaacgacaatgtcgtcggcagcgccggcaacgacacgatctacggcatgggcggcgacgacctgctgcagggcggcgccggcaacgatctgctgaatggcggcgacggcgacgacacgctggaaggcggcctcggccgcgacaccctggccggcggcgccggcgacgacctctacctgcatccgcgcgacagcggcgacgacctgatccgcgacaatcagggcagcaaccacctgcaactgggcgagatgagcgacagcctgtggctgtcgcgccgcggcgacaacctggaaatcagcctgccctacgcgcaaggcaaggacaaagtcaccgtggaaaactggttccgcggcgcggagcaccaactggagcggatctccagcgccgacggcaagaccttgctggccggccaggtggatgcgctggtttccgcgatggcggcgctgggcggcgacgctccgggcgccagcgccatgacgcagtcgctgcagcaggagccgctgcacgcgctggtggcctccagctggcactaagcgcaaacgcgctcgtccggccccgccgcttaatgcggcggggctttttcattccccctccggctgcggccccggttggctccgccaacgggcgaacccggccagcccgggttcaagcatgcgccgagcccgccgccttgcggtaaagactgcgccgcagcggataaagacaaagtttccagccagaaccagcccagtccgccccccatccctggaagcaagccggcatgggttttccggccgtcaaattagttagtttgctaattaacaaattgaccgctacaatccgtttacatcaccactatcggaacccggcccgccggccggtacaccccatggaagacatcgatttattgcgcctgaagctgaccagcagcctgcgcccgctgggcgtgctgtggcggcatatcgcgcaggaagcgctgaccgctcacggcgtttcggtatcgggcggctccgcgctgctgttcatcggccggctgggagaaggcgtcagccaccgcgcgctggcagacgagctgggcatggagccggcctccctggtccgcatcgtcgatcagctgagccaggccggcttgctgcgacgggaacagggtttgcaagaccgccgggtgaaaaccttgtggttcaccgacgccggccgcgaagtcacccgcaagatagaaacggaactggtggcgttgcgcgcgcgcgtgctggcgccgctcagccaggccgacctggaagccgcgctgcgggtattccaggtgctggaacaggcggcgcaaacccgcgtccccgacgacccgatgctggacccgccccatgatcgcgctgcccgctaaacgcgactggctgttctccgcccgcaccttcgccgccgcgatgctggcgctgtacatcgcgctggcgctgggcctgccgcggcccagttgggcgatgggcaccgtctacatcgtgtcccatccgctgatcggcgccacccgttccaaggcggtgtaccgcgtgttcggcaccctgctcggcgcagccgcagcggtatgggtggtgccgccgctggcaggccagcccgtgctgctgagcctggtggtcgcgctgtggtccggctccctgctctacctgtccatgctggaccacacgccgcgccactacctgctgcggctgccggcctacaccatgccgctgatcgcgctgtcggcggtgtacgcgccggaaaacgtgttcgacatcgccatcgcccgcagcgaggaaatcgccctcggcatcgtctgcgccagcgtgatggcggcgctggtgctgcccacccgggtatccgccgtgctaagccagcgcgtggacggctggctcaaggacgccgccgcctgggcgaccgacacgctgggcagcgcgccgcagccgccatccgccggccgcaatcggctggctgccgacctgctggcctttgaccaattgctcacccacctctcctacgacgccgccagccgcaacgccgagcgcaccgcgggcgagctgcgcgcgcggatgagcatgctgccgccgctgctgtcctcgctgtccggcctgcaggccgaattgcgcaacacgccgcaagggccgtcgccggcactcgcccagttgatggaggcgatggccgactggctgggctatcccgtcgacaacccctggtttctgagccaggcgcgcgcgctgcgccgccagctggacgacccgccgcctgccggcggctggccgtctttgttggaaagcacggtgcggatgcggctgaaatcgctggtcaatctgtggcaggactgcctgacgctgcgcgcgctgatttcgcgcggcgcgccgctgtgggactggcggccggcttaccgccgctgggaagtgggcgtgaaggcccgccactacgattacggcctgctcggcttcgccgccgccagcgccgcgctgggcattttcctgggttgcctggcctggatcgcgctgggctggcaggacggcgccaacgcggtggtgctgggcacggtcgcctgctgcctgttcggcgcgatggacgagccggcgccgatgctgcgcacgctgttcgtcgtcaataccgtctgcaccatgctggccggcctgctgctgttcgccgtgctaccggccgtgcatgaattcgagatgctggcgctgtgcctggctccgcccttcctcttgggcggcgcgctgatgaaccagccgcgcttcggcccggtggcgatgctgctggtggtgttcaccgccaatctgatcggcctgcagcaaagctacaacgccgacttccagtccttcctcaacagcaatctggccggcgcggccggcatcctgttcgcgctggtctggacgctggccacccgccccttcggcgcggagctgacgctgcgccgcctgatccgcgccaactggcgcgacctggcgcaaaacgccgccggccgccacggcggcgactacgagcggctgaccgcgctgatgctggaccgcctgtcgttgctggcgccgcgcctggccgccgacggcgccgactcgtccgccggcttccgcgaactgcgggtgggcttcagcgcgctggacctgcaacgcgacgagcaccgcctggccggcgccgcccaccaggcggtggacgcggcgctgcaaggcgtcagcgagcacttccgcgcctgcgccgaagccgaccgctatctcgacgcgcccggcgccttgcttggccggctggacgccgccatcgcgctgaccctggccgatgccgcgcccgccgcgcgcgaagcccgcaacgcgctggtggaaatgcgcgtatcgctattccccgacgccgcgggctgccagccggcgtcgcccgtttccggagcccagccatgataggcgaaatcaatttctacggggtgtacttccccagcctgctggtgatgatgctgatcgccttcgccgccagcagcctgctgtgccgcgcgctggcccgcctggacctgtaccgcgcggtgtggcaccgctcccttttcaatttcgcgctttacctgatcgtgctgggcggcacgatcgcgctgtttcacaggtgacatcatgaacaaccgcattcgcaaagccgggtccgtgctgctgaccctggccacactcgccgtcgccatcgtggtggtgcggcatatctgggtttattacaccgacgcgccgtggacgcgcgacggccatatcgccgccgacgtggtgcaggtggcgccggacgtgtccgggctgatcaccgaggtgaaggtggccgacaaccagctggtcaagaaaggccaggtgctgttcgtggtggaccgcgcgcattacgaactggcgctgcgccaggccgaagccgccctcgccgcgcagcgcgccacgctggcccaggcccgccgcgaagccgcgcgcaatcactcgctggccgacctggtggccgccgaggcccgcgaagagggcgacgccaaggtgcagctgggcgaggccacgctggccgccgccgaggccgccgtcggcgtggcccggctgaatctggagcgcaccgaggtgaaaagcccggtggacggctacctgaacgaccgcacgccgcgcgccggcgattacgccgccaacggccgcgcggcgctgtccgtcgtcgactcccattccttccacgtcgacggctatttcgaggaaaccaagctgggcggcgtagagctgaaccaggcggtggacatccagatcatgggcgaatcgcgcaagctgcgcggccacgtgcagagcatcgccgccggcatcgaaaaccgcgaccgcagcaacggcgcctcgctgctgcccaacgtcaaccccaccttcaactgggtgcggctggcgcagcgcatcccggtgcgcatcgcgctggacgaagtgccggccaatttccggctgatcgccggccgcaccgccaccgtgtcggtgcggcagggaggccgctcatgaaagccgcgctgaagctgagcgcgctgagcctggccggcgcgctggccggctgcgccgccgtcggcccggattaccatctgccttcgcaagccgcgctgggcaagcccgccgccaacgccgccttccagtcggccaaccatgcggccttcgcccagcagccggtccccgccggctggtggcggctgtatgacgacgccaggctggacagcttggtggaggaagcgctgacagccaacgccgacatccgcgccgccgcggccaatctgcgcaaggcgatggcggtggaagcctcggtcaacgccgagcgcgatccccacgccagcgtgtccgccaccgtccagcgcagccaggattccggcgaggcctacctgctggagaaaaagctgccggtggccaatgtcggcgacggcggcctgcaaatcggctacgagatcgacctgttcggcaagctggcccgcgccgaggaagccgcccgcgccggcacccaggccaccgaggcggcgatggatctggcgcggaccacggtggcggcggaaaccgtgcgcgcctatgtccagggctgcgccgccggacaccagctggcggtggccaggcacgagctggatctacagaaccgcggcgtggcggtggccaaacgcatgcaatccgccggccgcggccgcgccaccgatgtggagcgcgcccaggcccaggccgacatccagcgcgccgcgctgccgcgcctgcaggcggagcaggacgccgcccgcttccgcctggccgcgctgctgggcaaggccccggccgagcggcccgccgccgtctgctcggccctgccccagttgaagcagccgctgccggtcggcgacggcgcggcgctgttgaaacgccggccggacgtgcgcgaggcggagcgcaagctcgccgccgccaccgcccgcatcggcgtggccaccgcccagctctaccccagcgtcagcctgggcgcgtcggccggcttcaccggcctgctggaacacgtgggggaagaccgcacccagcgctggagcctggggccgctgatcagctggaccatccccgacagcggggcccgcgcccgggtgaaagcggccgaagccgacgccgacgcggcgctcgcccatttcgacggcgtggtgctgaacgcgctgcgcgagacggaaaccgcgctgaccttctacgccaaggatctggagcgcaacgccgacctgcgctcggcgcgcgacaacgcccatgccgccgcgcaggacaaccgccggctgtacgcggccggacgcgcgccctacctggccagcctggacgccgaccgcgcgctggccggcaatgaatcggcgctggcggcgtcggacgcgcaagtggcgctggatcaggtcagcctgttcctggcgctgggcggcggctgggagcaggcgccgcgctgaacctagcaatcgaacagaacgacaacaagatgaaacaggaagtgatttttctcagcgaaggcctggagctggtcggccatctgtaccgtcccgccgactatcaaccggagaagcgctacccggccatcgtggtcagccatccgttcaccggcgtcaaggaacaggtggcggggcgctatgccgagcggctggcgcaggacggctatctcgcgctggcgttcgacaccgcctaccagggcgagagcgagggcctgccgcgtcatctggaaacgccccattcgcgcgcggaagggatcaagtcggcggtcagctatctgtccaacctgcctgatgtcgaccccggacgcatcggcgcgctgggcatcgccgccggcggcggctacgcggtgttcaccgcccgcaccgacccgcgcatccaggccgtggccaccgtcaacgcggtttgccaaggcagcctgctgcgcgacgggctgaacggcagccgctcgtccgaacagctgcagggcctgctagccgcggcggcggaagaccgcaccgcccaggaccgcggcgaagccgccgccacccgcagcgctctggcggaaacggcgcaagcggcggccgaacaaccgcagagcctgctgcgcgaggcctacgactactaccgcacgccgcgcggccatcatcccaacgcggaaaaccgcttcgtgctgtccgggctggacgcgctggccggcttcgacgccttcgcccgcatcgacatgctcgcccagcggccgctgctgatgatagccggcgccgacgccgacacccgctacttcagcgaacaggccatcgccgccgccaccgagccgaaggagctgtgcctgatcgcctgggcctcgcacttcgacctgtacgaccgcgagccgtgcgtggcggccgccgcagccaagcttcaagcctttttcgacctgagcctggcctagccggccagcagcggcgccgcctcattggccgccgccggcgctccccgcagcgccggcaagccgtggctggcgcgcgccttcaggcattgcgccgaaccggcctccacttcgcggcagggactgggccgtagcggatacaccccacagccgacgctgtcgcccacctcgccctgcaaggcggcgcagcgcgggctggcggaccaggtgccgcgcatgcagcgggtccagtcgttgagcttttcggtgagatggctgggcaccaagccgccgccgtcatcggcttcggcccaatagaaagatacgcggaagctggcgcagcacgcgccgcaggattggcagggattgcttttttcactcatggcaagcaagaaaaacaggttgcggatcgcgcccgggatgggcgaatgaaatgctatccgagtattctgtcaggcctgcttgccgtcctcaagtaaaactattttgatgcatgccgctccagccagtcggcgatgccctgcccagccgcacggccgctggcgaagcaggcagtcagcagatagccgccggtgggcgcttcccaatccagcatctcgccggcgcagaacacgccgggcagcgcggccagcatctgcctctcatccagcgcggcaaagctgacgccgccggcggtgctgatcgcctcgtcgatgggccgcgccgctttcagcgtaacaggcaaacgcttgatcgccgccgccagcgccgccggattctggaagctgttcttgtccaggcattcgcgcaatatgccggcgcgcgcgcccttcaggttcagccggctttgcagatggctggacaaggagcgcgagccgcgcggatgcgacacttcggctagcaccctggcctcgtcccaggccgggatcaggtccaggtggcaggtggcggagccggcgcgggcgatctcgtcgcgcagcagcgccgagcaggcatagatcaggctgccctcgatgccgctcttggtgatcacgcactcgccgacgcgctggaatgcgcggccgtcgccgccctgaaaagccaggccgaccgacttcagcggctcgccggcgaacttgtcggcgaaaaaatcgctccaggcggcgtcgaaaccgcaattggacggtgccagcggcgcggtggcgacgcccttttccgccagccacggcagccaacggccgtccgaacccagcttcttccaactgccgccacccagcgccagcagcgtcgcgtcggcgcgcgccgccagctcgccgcccggcgtgtcgaacttcaggctgccgtcggcgttccagccctgccagcgatggcgcacatgaatgcgcacgccggcttcgcgcagccggctgagccaggcgcgcagcaacggcgcggccttcatctcgcgcgggaacacccggccggagctgccgacgaaggtttccacccccaggccatgcacccaggcgcgcagcgcgtcggcgtcgaaatccttcagcagcggctcgatctgctgagcgcggtcgccgtagcggccgacgaaggccgggtaagcttcggaatgggtgatattgaggccgccgatcccggccagcaggaatttgcggccgacggatggcatcgcgtcgtacacatccaccgcgcagccgcgcgcggccagcacctccgccgccatcaggcccgccgggccgccgccgatgatggcgacgccgcgccctgccttttcactcatatccgctccccaaaccgctgaattcgttccgttttcacaatagccctcgccgccgcagcccggcggcgagggcgcgattgttgcagaaatcgccgataaacccaagcgccggcccgcctttcacgcgccagagccgcttggcaagccttatccgcgcattgtttgatccaggccagacgcctggcaaccgccgccgactagaattcccacggcatagctccgcccgcatggcggcggcgacaaaccaaggagacggggcccaccaccccgggaagcgatgagaaaattttccgattggccgatctggctgcgtctgaccggcgcgatctggacctgcctggtattggcctggagcggcttgatcgcctgggaaacccaggccagccgccagatcgcggtagaacaggccaaagacctggcgcacagcatgaatgaaatgacgctggccggcctcaccggcatgatgatcaccggcaccgtcggccaacgcgacgtgttcctcgatcagatccgcgagctgtcggcagtgcgcgacctgcgggtgatacgcggcgatccggtcaaccagcagttcggccccggcaatgccggcgacaaggcgcgcgctggcgatgccctggagcgcgctgccctgcaagacggcaaaccgcgcatcgagatcgaatccacgccggaacaaggcgaacaattgcgcgtggtgtatccggcgctggcctcgcccaattatctgggcaagaactgcatgacctgccaccaggtggcggacaagaccccgctgggcgcggtcagcatgcgcatctcgctggaaaagccgtatgccgcggtggacagcttccgcacccagagcatcctgttcgcgctgctggcctcgctaccgctgctggcggtggtctacctgttcatccgccgcttcgtcacccggccgctgcaggagatgtcggccggcttggcagagctggcccagggcgaaggcgacctcacccgtcgcctgccggccgcgcacagggacgaaatcggcaccaccgccagccacttcaaccgcatgctggccacggtggccgacctggtgcgccaggtcagcgattcggccaacgcggtggcgcaatcgtcgcgcagcctctccggcggcgccaatcagctggccgccagctcccaccgccagaacagccagtcgctggccgccgccgaagcagtggaacagctggcctcgcacatcggcgaaatcgccggccaggcggagcaggtcagcaacggcgccgaagaaagcctgcagcgctcggaacagggccggcaaagcctgcgccaattgcagcaggaagtgggccaggtgcaagaagcggtgcagttgatggcccaggctgaaagcgacctggccaactccaccgccatcatcaccaccatgacccgcgaggtgcgcgaaatcgccgagcaaaccaatctgctggcgctgaacgcggcgatagaagccgcccgcgccggcgagcagggccgcggcttcgcggtggtggccgacgaggtgaggaagctggcggagaagtcggccaaatccgccagcgagatcgataccgtcaccggctcgctcaacagcaagaccgacgcggtgcgccaggcggtggccgccagcctggcgtcgctggacgccagccgccagtcggccgacagcgtggccagcgtgctggccgccggcaaccagtcggtggcggaagtgcgcggcggcctcaggcagatcgtggaagtcaccgagcagcagcgccgcaccagccagatggtcaatgagagcatagacgccatcgccgacatggcgcgcaccaacgacgccgacatccagcagacggtgggcgccgccgaggaactggaggcgctggcgcagcggctgaccgattcggtgtcgcgcttcaaagtgtgagcctatcccggcagaaacgagcgcatctgatacaactagataggaagaccccagcgcccggcttcgccgggctttttttcacgcgaaatgcgccgggcatttggccgcgagcctcactgctgttacactgcccagcctttagccaaccgcgccaagtcattgtgaaaccagccgctttttccaccctgcccctgcccgcccccttgctgtccaacctggacagcctgggctaccaccagatgaccgccatccaggccgccagcctgcccgccattctggaaggccgcgacctgatcgcccaggccaagaccggcagcggcaagacggctgcgttcgggctgggcctgctggccagcctcaatccgcgctggttcggcgtgcaggcgctggtgatgtgcccgacgcgcgagctggccgaccaggtggcgcaggaaatccgccgcctggcgcgcgccatcgacaacatcaaggtggtgacgctgaccggcggctcgccgatgggcccgcagatcggctcgctggagcacggcgcccatatcgtggtgggcacgccgggccggctgcaggaccacctgttccgcgaaacgctgaacctgagcggcgtgaagacgctggtgctggacgaggcggaccgcatgatagacatgggcttcatcgaggagatcgtcggcatcgtccgcgcctgtccgaaaacccgccagaccctgctgttctccgccacctacccggaagacatccgcaaggccagctcgcagttcctgagaaacccggtggaagtgaaggtggagtcgctgcacaacgccgaccacatcgaacaatggttctacaaggtgaagccggaaacccggctggagacggtcagccgcatcctgcgccatctgcgccccacttcggcgctggccttctgcaacacccgcgagcgctgcaaggaattggtgcgtgagctgcaggaacagggcttcaacgcgctgacgctgcacggagacctggaacagcgcgagcgcgaccagatcctgctgcgcttcgccaacaagagcgccaccgtgctggtggcgaccgacgtggcggcacgcggcctggacatcaaggaactggacgtggtgatcaacgtcgacgtcacccatgatccggaagtgcacatccaccgcatcggccgcaccggccgcggcgagcagcacggcctggcgctgaccctggccaccgacagcgaggccaagcgcctggtgcagatcgaaaactaccagcaggccgacctgacctgggccgacgtggaagagctgacacctgcgcccggcggcccgctgctgccgccgatggtgacgctggagatcgccggcggcaaacgcgaaaagctgcgcccgggcgacctgttgggcgcgctgaccggcgacgccggcttcgccggcagccagatcggcaagatcaatatcttcgaattcgcgagcttcgtcgcgctggaccgcgccatcgccgaacaagcgctggccaagctgtcgcaatgcaagatcaagggcaagcaattcaagatgcggctggtcggctgatccattccgccatcaagaaaaaggccatcccgcgggatggccttttttgctggctggcgcaacgcaaaatcggcacttagtacggccggtcgcccagtatcgtcgcccggtgcatcacccgccgcgccggccggtagtcgtccaccgcgtagtggatggtgcagcggttgtcccagaacgccacatcgccggcctgccagcgccagcgtatcgaaaactccggcctggactggtgggcgaacaggaactgcagcaaggcctggccctcggcttccggcaggtcgttgaccgcgacggtgaagccctcgctgacgaacagcgcccggcggccgctttccgggtggatgcgcaccagcgggtggctgatcggcggatgcttgcgccgcgtctcgtcccagcggcggcggtcttcgtcggtgacgccgtagcgcgccagcgggaaggatttggcgaaatcatgcaccgcgctcaggccttccagcctggccttcaggctggccgacaacgcttcgtaggcggcgatgccgctggcccacagcgtgtcgccgcccagctccggcagctcgcgcgccgccagcactccgcccagcggcggggtttcgatgaaggtgacgtcggtgtgccagatcgcgttgtcctgcaaatccaccacatcggtgtccaacaccatgatctcgcgcgcctccgggtgctgcggatagatcgggtgggtgtgcaggtcgccgaagcgcaccgcgaaattgcgctgctgcagcggggtgatgtcctggccgcggaaaaacagcacctggtagcgcagcagcgcctcgttcactgcccggcgctgctcgtcgtccaacggccgcgccaggtctatcccctccaccaccgcgcccagcgccgggctcaggcgggtcaattgcaaactcatgcgtatcccctcttgtatttagtcttgttgcccatgccaaggcgccagccggcgctgcaaggcccgcaggcccagctccagcgcgaaggccaccgcggcgatcaccaggatgcccagcaccaccacatcggtgaccagaaactgcgccgccgactgcaccatgaaacccagcccgcgcgtggccgccaccagttccgccgccaccagcgtggaccagcctgcgcccaaaccaatgcggatgccggtcaggatctgcggcagcgcctcgggcagcaccaccagccacagcaactgcgcgcggctggcgcccaggctttgcgcggcgcgcagccggttgcggctgacttgggccacgccgtggcgggtggcgatgaccaccggcgccaggatggccaggaaaatcagcagcaccttggacagctcgcctatgccgaaccagatcacgatcaatggcaggtaggcgagcggcggcaccggacgatatgcctccagcatgggatcaagcaagccctgtgccagccggctgcgccccatcagcgcgcccagcggcacgccgaccgccgccgccgccatcagcgccagcgcgatgcgttgcaggctggcctccaggtgctgccacagcgtggcgtccatgaagccctggccggcgacgacaaacagcttgttcaataccgcctccggcgcgggcagaaacaacgccggcacccagccgctgtgcgccagcagccaccagccgcccagcagcaatgccaggctggcaacgcccagccatagccgggagggctcgcgttcccgcctcgggctgccctcgatccgagaggaaacggacaacaactccgcctccgccgtggtttcaatgccgctcatgcccatgcctcttgtctgcgctgggcgaacacgtcggccagcagttgttctctcagcgcgatgaattccggatcggacttgatctcccgcgcgctgtcgccggcgcgccagcggcggctgaacggcgggcgcagcgtcttgacgatgcggcccggccccggcgacatcaacaccagctcggtggcaaggaacagcgcctcttcgatgtcgtgggtgatcagaaacacgctgccgccggactccgcccataccttgagcagcagctcctgcatctgctcgcgggtgaaggcgtccagcgcgccgaaaggctcgtccatcagcagcgtgccggcgcggccggccaaggcgcgggcgatgccgacgcgctgcttctgcccgccggacagctgccaggggtagcgggcgccggcctcggccaggtccacctgttccagcgccttctgtgccagctcccggcgctcggcgcgcggcacgccgcgcagacgcaagccgaaggcgacgttgtccagcgcgttcagccacggcagcaaggcgtgctgctggaacaccaccgcgcgctccgcgcccggcccggttaccggcgcgccgccgaagcgcacgctgccggaatcgggaaactggaagccggcgaacagattgagcaaggtggtcttgccgcagcccgacggccccagcgccactgccagctcgcccggccccacgttcagcgacaccccgtccagcgccggttgcgcctggccgggataacggaccgacacccggtcggcgatcagggcggccatgtttagcgcgccgtcttgacgaagcggttggtcacgtaggggccgtaatccggctgcagcgattccaccttgccctgcgccttcagaaaggccgcggtcttgcccaccgccgccacgaacggcgattgcagcagcgcggcctgttcgtcgcggccgaggaagcggttgcccttcagccccgccaccacgtccggcgcggcggcgccggtcagccggctgatcttggcgatattggcggcgttggcgatgaaggcctgcggattcgcctggtagccggcgatggcgtccagcgacaccttggcgaagcgggagacgaactcgggatgggcggcggcgaagtccttgcgcaccacccagatgtcgtaggtgggcgccccccacttggccacctcggccgagctggtcagcaccgcgccgccgggcttgatcttgcccagcgccgggtcccaaacgtaggcggcgtcgatgtcgccgcgctgccaggcggcggcgatctcgccggggcgcagattgaggatattcaccttggccgggtccacgccccagtggtgcagcgcggccagcaagctgtaatgggtggtggagacgaaaggcaccgccaccttcttgccgatcagatcctgcggcttggcgatgccgctgcccttgcgcgccaccagcgcctcggcggagccgatttcgtcggccaccaggaaggtttcgatcggcaggccgcggctggcggcggccgccagcgggctggagccgatattgccgatggccacatcgcctgaagccaccgcggcgatcaggtcggcgccgctgtcgaacttgcgccagttgatgcggctgccggtggctttctcataggcgccgtcggcctgcggcaccttggtggggtcgatgccggtctggtagccgacggtgacggcatccgccgccgcagcgacgcccgaaacggccaatgcggcggaaaggatcagtttgagaaatgcgcgcggtttcgccatggcttgtccatttggtacgagttggaaatatcgtaccaatctaacaagcctacctccataggctaaatgctgatttataaaaagctttacactttattgaatatactcgatgaccaacccaatgcttcacgcccagagcagcaaaaaattcgacttaaccacccatgtcaatccgtaggctactcttactagcgccaatgccaacttgtcacttcagatggaaaacgaaatacaccctacatcacatcacctgtttcctgcttgctgccatccattacgaaaatcatgcaaagcacacagcctttaaaattaccaccaccaaggccttgacaaaacaagccatagaaagaaggtgccgcactcaaactattttaaaaaacaactaactgggcatacgcaacggtatcaaattatgaactgcagcccgttccaacaattgacttgtggtgttgacatcgaatttgacatataatctatcgctgatcgctgtctgtaccgcccgaactgaaatatctttcccatgaagaaccgacagtatccttgctatctctttaggggatttataaatagatagatagtaaataatttcactctctcgactactcaaactgatttgccgcctacctatcccctcactcctctggcttaacccgacacgctgctcaacgattgatagcttggtgtgctgaacttcattcataaacttgccaaccaagtcagccagttgcaagtgcagcttatcaatacttctctcccgctctatctcctgcaatctcctttcaattgttacatccttacaaaaaccaacaagccctgcaatttctccgtcttgcacaatcggatgtttgatggtttcagaccaaaccacctcaccatcgccagatggaatctgttccaacctcgatactatctgcccggcctccaatacttgtcgatcgtccctctcgaattgctcccagttacgagcccaaggcaagtcaatatctcgcttctcaagaaggctatcaatattttcaacatcaaccatatccaagaacttctggttgcaacccatgaaatatcgttcagcgttcttccaaaatgtaggaacagggctacaatttataatctgaaagtacttatccgtcttgtccataccgttttccaatatctgccctcttaagccaggcgacaaaatcattcacttcgatgcttccctcatccggagcccaactagcaaatgtcctatcgacctccggctggccataaacaaacctgcaattccttatctcaagatatgcacaatcagacaagggcacataactgtgatactgattacgctgtatctccattatgcgattacttcgctgccctattttaactttattcagaattctgcctaaatcatcaaagatgacaataagcatctcccctgacatccaagttactagctcccattgattatcgctttcatgcttatgcggcttaatataagagtccgatgccatgcaatttacaaagcgctgtggaatttcatcataactatcgtgaacaagtatcgggatacgcttcctaggtacccctttgctttcttcaataacagtttcgatatagtcattgctaataagtttggactttattgtctgcacgttgattgttccttgtggaactatttgcaaaatgccgttatagtaacacatgccaaagacatgtggaacagttgttattgcgccataaaaaatacttagcacatataaaattccaccacctccgtctgttggaatttaccaccatgaatcccgaagaatatgcatacaaacacccttcctgtataggtttgctgtctttcaaaaatgtgttcgcccaagtggtcgctcaacatgtttgctctttacccgatgacgaactgctccagcttgaggcctgttcatggccacatggcaagatagccgacatggtctgcatagacgaggtatcggttagcgacatgttggcatctccgttttatcaaccaagagcatctgtcatcgcttacatcgacctcaaaccggtgctctactacaacggagcgggtatctaccaatggagcgatacgctggataagcaatgcctcagctactggcttacccacccagagctgccgccaggctgggagctgaactaatatggtgattgattttcagcgggcgagaagtcttagactggaaaacaaagacgactgccatgacgccatcgtgctgcttgcgggctatttcagcccagcagagatcagcaacgcagagattgagtgctacaaggttagccacgcggatatagccttgatccgcgatgccttcaagcgcgccgcgcccggctaagtaattaatcccggcttgcttatcgcttttcctgcaaaacgtccgatccaaaaaaacagggcctttcggccctgtccggtcttccccgaccctctcgttgtccgtgtttacacttggtactgcgccaccgtcttctggatatggccggcctgctctttcagctgctgcgccgaactggccgaatcggacgaggctttggaattggcttccgccatctgggcgatctgctccaccttctgcgcgatggtgttgctggcgctgccctgctcgacgatgctgtcggaaatctcgccgatcaacagcgtgctgtgctcggaattggtcttgatctgctggatggcgtcgctggccccgcgcgccttctccgcctcctggttgacccggtccaccacctgctgcatgccggtcaccgccgcctgggtgccttgctgcatcttgtctatcaccgcggaaatctcggtggtggaactggcggtgcgctcggccagctttctcacctcgtccgccaccaccgcgaagccgcgccccatctcgccggcgcgggccgcttcgatcgccgcgttcagcgccagaagattggtctggtcggctatgtccttgatcacgcccagcaccgtggcgatggtgacgctgtcttcccgcagcttgcctatccggtcggacgcctcgcccaccgattcggccaccgcgctgatgccgtccaccgtgcccagcaccacccggctgccgcggtcggcgatctcgccggcctcgcgcgcctggtggttggcctcgcgggcacggtcggcgacgtggttgatgctgaccgtcacctgctccaccgccgccgccatcgccgacgccgattcgctctgctgcaccgaactatgggcgatgtggccggaggagtcggccatatggacgatggcatcctccatcgcggtcacgctgccgcggatctcctggaagctctgctgcagcctggccatcagctcattgaaggcggtggcggtcttgccgatctcgtccatcctcgccaccggcgcgcgcaggcggaagtccagcgaagtccgcaccgactgcatggtgctcagcgtctgctccaggctgctgcggatgttgaggaacagatggccgctgagccagccgcatatcacgacggccaggccgatcaatatcgccgattgccaccacgcggcggcataggccgcgtcgttgtccttgctcagttggtcggcgagcttgtagttgaactcgatgtggtcgatcagcgcctggttcagcgccttggcctcgttggacatgtcgccggtcatcagcttgtccgcctccgccacattactgccctgcagcagctgcaggtacttgtcgcgctgctggcggtaaagcttcatgtcgtcgcggtccacctgcagcagcttgcggtcgtcgtcgtttgagatcaggtccttctcgtacttgtccagcgccgcgtcaaaacgcttgtccagatcggccagcgcggcgaactccgccttcttggccgccggatcggacagcgcgacgctgcgcgccaaggtcagcctcacatccgccagcgcctccttggcgtcgtccagggtgtggatgctgggaaaagtgttgatcttcatgtaatcgaagcggtcgttcgcctgctgctgtttccacaagccctgcacgcccagggccagcatcgccagcagggccagcacggtggtcaacagcagtctcttggtaatcgtcatgtccaactccttgcaggccaagcgcttcagactcggtttacgagaatttacttaggatatttatagctttgtttatccaacaaacaataaatcaatgcgccgaaaatcgcgcatggcagtccgccagcgccttgattattcgaaagtattttcatgtatagataaaacagggtatgatttcgccccttgcttgcggcatcggtgcgcggaaaaccgcggcggcgccaaccgaaactcactgggttccctcaccccattcagcaaaaaggatgcatccatgttcgccttcaccgaccggcagcgcctgtccgcgctggtccagctgtcgctgttccatatcgccatcatcgcttccagcaactacctggtgcagctgcctatcaccgtgttcggcttccacaccacctggggcgcgttcacctttccgttcatcttcctggccaccgacctgaccgtgcgcattttcggcgcgccgctggcccggcgcatcatcctggcggcgatggtgccggcgctgctcatctcctacctggtgtccacgctgttctaccagggcggatggcagggcatggcggcgctggagcagttcaacctgttcgtcgcccgcatcgccgccgccagcttcgccgcctacgcgctgggccagatcctggacgtgcaggtgttcaaccgcctgcgccagctcaaggcctggtgggtggcgccggccgccgcgatgttcctcggcaacatcagcgacacgctgtccttcttcttcatcgccttctacaagagcagcgacccgttcatggccgccaactgggtggagatcgccctggtggactacagcttcaaggtgctgatctgcatgctgttcttcctgcccatgtacggcgtggtgctgaaaatgatagtcaagcggctgctgcgcgccggcatcggcgaacagctgcagccggcctgagcgtcccggcaaaacaaaacggccagccccctgcggagctggccgttgcgcatggcgcggcgaggatcagccccgcatcgcctcccacaccttggcgctgtcgacgatctgttcgaacttgacgatcttgccgcccttcagcgtgtagacatgggcgaaggacgcgctgaagcttttgccggtagcgcgataagtgccgtggtagaagccctgcgccaccacgttgtcgccgtcgacgaaatagcggtccaccgccgcgcggtagccgtcccactcgctgcccagccgctggaacacgttttcgacgatggcctgcgggccgacataggtgccggcgtacgggaagcctgccgcctcggtccacgccgcgtccggcgccagcgccgccagcaggttgcggccgttgtcctccgacttgccttcgtaagtggcgcggacgatgtcgagattgctgcgttgagtcatggggcttccttcaggaaaacaagaatggttctcaaatatagccaagaccgcgccaattcaagcctggccggcggccaaaccggcatattcatattccatgccgccgcagccggcgcgcggcgccggccgtatactaggcggatcgcgcgcgccgcggcgcgcctgctctctgataggcttcgcacatgatctcttccgccccgcgcctctccatgctggagctggcccccatcgtcgccggcggcgacgccgcccaggcgctgcaaaacagcgtgcggctggcgcagcacgtcgaacaactgggctacacccgcttctgggtggccgagcatcacaatatggccggcgtagccagctccgccaccgcggtgctgctgggccagatcgccgcccacacccaaagcatgcgggtcggctccggcggcatcatgctgcccaaccacgcgcccttggtggtggccgagcaattcggcacgctggccacgctgttccccggccgcatcgacctgggcctgggccgcgcgcccggcactgaccccctcaccgcccgcgcgctgcgccgcgaccgcttcgccggcgaagacttcccgcagcaagtggctgagctgcgcggctatctggcgccggcgcaggctggccagcaggtgcgcgccattcccggcatcggcaccgaggtgccgatatggattctgggctccagcctgttcggcgcgcagctggcggcgcagctgggcctgcccttcgctttcgccgcccacttcgccccggcccagctgggcgaggcgctgcaactgtatcgccacctgttccagccatccgccgccctggccaagccatacgcgatggtatgcatcccggcgctggcggccgacagcgacgaaaaagcccgccgcctcgccaccaccccgtaccagaaattcctcaacctgatccgcggcgaccgccagccgctgcccgcgccggtggacagcatggacggcctgtggaatccgcgcgaggaattctccgtgcgccacgaatggctgggcgcggcggtgttcggcggaccggcgacggtgaaggccgggctgcaaaaactgctggacgagaccggcgccgacgaaatcatgctgtcggtcgattgccacgatttctccgaccgcctgcgctgctgcgagatcgtcgccgacatcctgccgcagctgaaaaccgcgcaggccgcgcccgccgccgcgaattgaaacccgaagcctgagccgacaaaaaagccgcggcccctgccgcggctttttccggttcgatccgggcagaaagcccggcagccgttaatcggactctccggcgatcagccggtacaccctcgcgcccagcaccgcgccgataatcggcgccagccagaacagccacagctgctgcaccgcccagccgccgacgaacaaggccacgccggtgctgcgcgccgggttgaccgaggtattggtgaccgggatgctgatcaggtggatcaaggtcagcgccagacctatcgccaaaggcgcgaagcccgccggcgcgcgcttgtcggtggcgcccatgatcaccagcaggaaaaacagggtcatcaccacctcgcacaccagcgcggccgccagcgagtagccgcccggcgagtgctcggcgtagccgttggaagcgaagcccttggccacgtcgaagccggccgcgccgctggcgatcgcgtacagcaccgccgccgcggcgatgccgcccagcacctgcgccgcgatgtacggcgccagctgcccggcgggaaagcgcccgccggcccacaggccgaccgacaccgccgggttcagatggcagccggaaatgtggccgatcgcgtaggccatcgtcaccactgtcaggccgaaagccagcgccaccccggcgaagcctatgcccaggccgggaaacgccgccgccagcaccgcgctgccgcagccgcccagcaccagccagaaagtgcccagaaactccgcgccatacgatttcatcgcttctccccttcaggttttgaaaaccaggccgccgcggcggcgcatgcggaatgcgcgctgaatgccgggtcgggtgccgtttaaccatagcaaatgggaatcaacggcacgcgcccggcgcggaattccgtggcgcggccctggtcaaaccggctgcccaggcgatgccgcccctcttcaacacgattgaaagccgatacggatcatggaaggaatgcttgcaggcctgctcgccgcgctggctttgccgaaagtcggtttgcccgccattttcgcagtcagcctgatctccgccacgctgctgccgctgggctccgagcccgcggtgttcgcttatatcaagctcaggccagacatgttctggcaggtgatggccgtcgccacgctgggcaacaccctgggcggcatgatcgactggtggatgggctacggcgccaaggtcggattgctgcgctaccgccagcgccgcagccaccacatgcatggccattcccacgccaagccggacggacggccgccgcgcgcgcgcaagcccgcgctgaacccgcgctatttccgctggatgcgccgccgcggcgcgcccatcctgctgctatcctggctgccgggcatcggcgacccgctctgcacgctggccggctggctgcgcatcccgttctggccctgcgtctgctacatggcgatcggcaaattcctgcgttacctggcggccacctccgccctgctgtggattccggacgatttctggcgcgacctggcccaatggctttgaagcgaggccgcaagcggaaagcattcccacaaaaaacaacgacatattccaaacaagaccacattctcgacagggtggtgcgggattgcgctctgcggtaatctgccggcgaagccgcccggccatgccggcggcgcggcccgcgcaccttggcccggcaaccgttacaatacaaactaagagacgcctcgcggcgcccgacaacaacccggacccgatccgggactttcccttagagaagcacgaccatggcaatcagcgttttcgacctgttcaaaatcggcatcggcccatccagctcccataccgtgggcccgatgcgcgccgcccgccaattcatcgcccgcctggagaaggatggcctgctggacgccgccacccgcgtccaatccgagatgttcggctcgctgggcgccaccggcaagggccacggcaccgatgtggcggtactgctgggcctgcagggcgaacaacctgacctggtcgacaccgacgccgtggacggcatgctggccgccatccgcgagcagcgcaagctgaagctgctgggcaagcatgagatcgacttcatcgaagccgagcacctggtgctgcacaagaagaaaacactgccctatcaccccaacggcatgatcttcgaagccttcgacgccgccggcaacagcctgtccaagcgcgcctactattcggtgggcggcggcttcgtggtggacgaggcggccatcgacgccggcttcgtcccgccgggcgtcaccgagctgaagcacccgttcaagagcgcggcggaactgctggcgctgtgccagcgccacggcaagagcatcagccagatcatgctggaaaacgaactgtcctggcgcagcgaggaagaagtgcgcgccggcctgctcaacatctggaacgtgatgcaggcctgcgtgaagcgcggctgcgagcgcgaaggcattctgcccggcggcatgaaggtgaagcgccgcgccgccgacatgcaccgcaaactgctggcgtcgccggaagccgcgatgcgcgacccgctgacggtgatggactgggtcaacctgtacgcgctggcggtgaatgaagaaaacgccgccggcggccgcgtggtgaccgccccgaccaacggcgccgccggcatcatcccggcggtgatgcactactacgcccgcttcgtgccgggcgccagcgacgatggcatcgtccgcttcctgctgaccgccggcgcgatcggcatcctgttcaagctgaacgcctccatctccggcgccgaagtcggttgccagggagaagtgggctccgcctgctcgatggcggccggcgccttgtgcgaagtgatgggcggcacgcctgagcaagtggaaaacgccgccgagatcggcatggagcataatctgggcctgacctgcgacccggtgggcggcctggtgcaagtgccctgcatcgaacgcaacgcgatggcgtcggtgaaagccatcaacgcggtgcggatggcgctgcgcggcgacggccagcatttcgtgtcgctggaccgcgtgatcaagaccatgcgcgacaccggcatggacatgagcaccaagtacaaggaaaccgcgcgcggcggcttggcgatcaacgtgatcgaagtgccggtcaacatcgtcgagtgctgagcccactcccgtgaaacgacaacagacggccgcgagcatccgcggccgtcttttttcttgctggcacgcttgccgcccaatctggcacactagtgccgatatcagacgccatcagagccccttcccgtgcacgcacttgaaatagaaacgccccgcctgcgcctgcgcccgctcctggagcgggacgacgccttcatcctggaattgctgaacgaacccgccttcctcgccaatatcggcgacaaggacgtgcgcgatctggccggcgcgcgcaactacatagaaaaaggcccgcaggccagctaccagcagcacggccatggcctgctgctggtcgaactgcaagccggcgccgttcccgtcggcatctgcggcctggtcaagcgcgacagcctgccccaccccgacatcggctacgcctttctgcagcgccactggggccgcggctacgccagcgaggccggcgccgcctgcctggctcacggccgcgagcggctgaacatagactacgtggtgggcatcaccgcgccgggcaatctgggctccatccgcgtgctggaaaagctgggcctgcaatacgaccgcacgctggcgctgcccggcatcaacggccccagcctctactacgttcccgccggccgcggcgagaaacccgcctgagcgcgcctccgagccgacaccgcgggcatgaaaaaaccgggcgcgaggcccggttttttgtctgctgcggaggcgaggatcagaccgacaggtaggacgactgcttcaggccgcggcagaactcggcgaagaactggctgcgctcctcggcgctgagatcacactcgcgggtcttggcttcgtagcggttgagcaggtcttccggcgacaggtgcacgtagcgcagcatgtcctcgatggtgtcatgctcttccacaccggagaactccagctcgccgccttggcgcacgtaaacgttgaccgaatcggtatcgccgaacagattgtgcatgtcgcccaggatttcctggtaggcgcccaccaggaacaccgcgatcaggtactcttcgccctgcttcacctcatgcaccgacatgctgttctcgatgctctgctgatcgacgtagtgcttgagcttgccgtcggagtcgcaggttaggtcctgcagcaccgcgcggcgggtcggctgctcggccagccggtgcagcggcatgatgggcagcacctgatcgatggcccaggtgtccggcaggctctggaataccgagaagttgcagaagtacttgtcggccaggcggtcggtcagctcgtcgtacacctggcgctgcgaacgctggctggcttgcagctgggtgtgcagacggcggcacagcgtggcgtggacttcctcagccagcgccttttccttcagcgacaaccggccttccgcgtacatgtcgctcacttccgacacgcaatggctggcgcggtagtagatttcagtgaccagctcttcatcgttgaggctggccagctccaacagcttgcgcaacggcagcgacagcgcttccacgttgtcgatcttggacacggtgtcaggcaggcgctcgacatcggtgacattcatcagcagcaccgcgtggtgcgcggtcatcgcgcggccggattcggacaggatgcgcgggtgcggaatgccgttctcggcgcagaactccgacagcatggagacgatcacgtgagcgtattcgtccatgtcgtagttgatcgagctgtcgttgcgcgagtgggtgccgtcgtagtcgacgcccaggccgccgccgacgtcgacatggtcgaccggcaggcccagcgcgcgcagttcggcgaagtagcggatggcttcgcggaatcccagccggtagtcggcgatattggcgatctgcgaacccatgtggaagtgcatcaggcgcacgcagtcggccatgccggccgcggtcagcttgtccaccgcggagatcagctggccggcggacaggccgaacttgcccttctcgccgccggtgtccgaccatttgctggaggccagcgacgacaggcgtacgcgcaggcccagattggggcgcacgccgagcttcttcgactcctcgatcaccagctcgacttcggattccttctcgatgacgatgaacacctggtggcccaggcgctcgccgatcagcgcgaggcggatgaattcgcggtccttgtagccgttgcagacgatggtgcagcccttgggcgccagcgccagcaccgccatcagctcaggcttggagccggcttccaaaccaatggaaacttcctgcgtggcgatgatgctcttgaccaccgcttcttgctggttgaccttgatcggatagatggcggtgtagcggttgccatagccttgctcggcgatggccttgtcgaacgcgccgcacagccggctgacgcggtcttgcagaatgtcggggaaacgcaccagcagcggcagatccagtcccttggcgcccagctcgtgcaccagccggtacagatcgatttccttttgctggcggacattgggacgcacgacgatattgccgctgtctccgacgtcgaaataaccagccccccaatgccggatgccgtacaggctccggctatcagccacagaccaagccatgagttttcctctcagaacttatgatggataaccccgctccttagtgcacggctttcgggctctacagcttttatgtgggcctgggatgtcggagcgaaacagaatgaattgttagttgttgcatagcgcaaacgagcgcggattgtaacaacatctcgctgattgacaagtaaaaaaatgtacccgttccgacgcgtccgatcgaattctccgccccttgccgccgccatggtttgcacagtgaaaattcatggcagttaaaacaatgaattgcatgccaggcgcgcgctccggcatgacattcaacagtgcttcgccgcgctcgcggtgtgcgcgatttccaacaaaaacacccatcccgagccgggaggcggcgccggccgcgccaagccgggcatgacgcggccatggccaaagattacaatcggccatccatcacttccatcatgccgccatgacccaagccagccgctttctgcaacacgcgctccatcccgacgccggcgccgacgcgtcctggccgctgccttccggcctgcaggcgcgctgggttgccgccggctgcgtcgaaatagacccgggcctgccccaggccgattcggtattgctaagctgcggcgtgcacggcaacgaaaccgcccccatcgaagtggccgacgccatcctggccgacatc
